US011236356B2

(12) United States Patent
Lagudah et al.

(10) Patent No.: US 11,236,356 B2
(45) Date of Patent: Feb. 1, 2022

(54) WHEAT STEM RUST RESISTANCE GENES AND METHODS OF USE

(71) Applicants: Two Blades Foundation, Evanston, IL (US); Commonwealth Scientific and Industrial Research Organisation, Acton (AU)

(72) Inventors: Evans Lagudah, Ngunnawal (AU); Sambasivam Periyannan, Turner (AU); Burkhard Steuernagel, Norwich (GB); Kamil Witek, Norwich (GB); Brande Wulff, Thuwal (SA)

(73) Assignee: Commonwealth Scientific and Industrial Research Organisation, Acton (AU)

(*) Notice: Subject to any disclaimer, the term of this patent is extended or adjusted under 35 U.S.C. 154(b) by 378 days.

(21) Appl. No.: 15/749,971

(22) PCT Filed: Aug. 3, 2016

(86) PCT No.: PCT/US2016/045390
§ 371 (c)(1),
(2) Date: Feb. 2, 2018

(87) PCT Pub. No.: WO2017/024043
PCT Pub. Date: Feb. 9, 2017

(65) Prior Publication Data
US 2018/0305711 A1    Oct. 25, 2018

Related U.S. Application Data

(60) Provisional application No. 62/200,894, filed on Aug. 4, 2015.

(51) Int. Cl.
*C12N 15/82* (2006.01)
*C07K 14/415* (2006.01)
*C12Q 1/6895* (2018.01)

(52) U.S. Cl.
CPC ........ *C12N 15/8282* (2013.01); *C07K 14/415* (2013.01); *C12N 15/8205* (2013.01); *C12Q 1/6895* (2013.01); *C12Q 2600/13* (2013.01); *C12Q 2600/156* (2013.01)

(58) Field of Classification Search
CPC .................................................. C12N 15/8282
See application file for complete search history.

(56) References Cited

FOREIGN PATENT DOCUMENTS

WO    WO2014194371 A1    12/2014

OTHER PUBLICATIONS

GenBank Accession No. BAK08360, submitted on May 20, 2011.*
Periyannan et al, Theor. Appl. Genet (2011) 122:1-7.*
Periyannan et al, Science (2013) 341:786-788.*
Steuernagel et al, Nature (2016) 34:652-655.*
Database EMBL [Online] Jun. 25, 2009 "Triticum aestivum cDNA, clone: WT012_L08, cultivar: Chinese Spring.", retrieved from EBI accession No. EM_HTC:AK335360, Database Accession No. AK335360.
Database UniProt [Online] Jun. 26, 2013, "SubName: Full=Disease resistance protein RPM1 (ECO:0000313/EMBL:EMT20152.1); SubName: Full=Uncharacterized protein (ECO: 0000313/EnsemblPlants:EMT20152);", retrieved from EBI accession No. UNIPROT:N1R489, Database accession No. N1R489.
Database UniProt [Online] May 29, 2013, "SubName: Full=Putative disease resistance protein RGA1 (ECO:0000313/EMBL:EMT10593.1); SubName: Full=Uncharacterized protein (ECO: 0000313/EnsemblPlants:EMT10593);", retrieved from EBI accession No. UNIPROT:M8C621, Database accession No. M8C621.
Periyannan, Sambasivam K., et al: "A robust molecular marker for the detection of shortened introgressed segment carrying the stem rust resistance gene Sr22 in common wheat", Theoretical and Applied Genetics; International Journal of Plant Breeding Research, Springer, Berlin, DE, vol. 122, No. 1, pp. 1-7, Aug. 1, 2010.
Olson, Eric L., et al.: "Development of Wheat Lines Having a Small Introgressed Segment Carrying Stem Rust Resistance Gene", The Plant Genome, vol. 50, No. 5, pp. 1823-1830, Jan. 1, 2010.
Periyannan, Sambasivam, et al: "Identification of a robust molecular marker for the detection of the stem rust resistance gene Sr45 in common wheat", Theoretical and Applied Genetics, Springer, Berlin, DE, vol. 127, No. 4, pp. 947-955, Jan. 28, 2014.
S. Periyannan, et al: "The Gene Sr33, an Ortholog of Barley Mla Genes, Encodes Resistance to Wheat Stem Rust Race Ug99", Science, vol. 341, No. 6147, pp. 786-788, Aug. 16, 2013.
Steuernagel, Burkhard, et al: "Rapid cloning of disease-resistance genes in plants using mutagenesis and sequence capture", Nature Biotechnology, vol. 34, No. 6, pp. 652-655, Apr. 25, 2016.
International Search Report and Written Opinion for PCT/US2016/045390, EPO, dated Oct. 12, 2016.
D. L. Klindworth et al, "Introgression and Characterization of a Goatgrass Gene for a High Level of Resistance to Ug99 Stem Rust in Tetrapioid Wheat", G3: Genes|Genomes|Genetics,vol. 2, No. 6, Jun. 1, 2012 (Jun. 1, 2012), p. 665-673.
Ravi P. Singh et al, "The Emergence of Ug99 Races of the Stem Rust Fungus is a Threat to World Wheat Production", Annual Review of Phytopathology.,vol. 49, No. 1, Sep. 8, 2011 (Sep. 8, 2011), p. 465-481.

(Continued)

*Primary Examiner* — Mykola V. Kovalenko
(74) *Attorney, Agent, or Firm* — David M. Saravitz; Williams Mullen

(57) ABSTRACT

Compositions and methods and for enhancing the resistance of wheat plants to wheat stem rust caused by *Puccinia graminis* f. sp. *tritici* are provided. The compositions comprise nucleic acid molecules encoding resistance (R) gene products and variants thereof and plants, seeds, and plant cells comprising such nucleic acid molecules. The methods for enhancing the resistance of a wheat plant to wheat stem rust comprise introducing a nucleic acid molecule encoding an R gene product into a wheat plant cell. Additionally provided are methods for using the wheat plants in agriculture to limit wheat stem rust.

9 Claims, 30 Drawing Sheets

Specification includes a Sequence Listing.

(56) References Cited

OTHER PUBLICATIONS

Vincent Pujol et al, "Identification of a stem rust resistance locus effective against Ug99 on wheat chromosome 7AL using a RAD-Seq approach", Theoretical and Applied Genetics.,vol. 128, No. 7, Jul. 1, 2015 (Jul. 1, 2015), p. 1397-1405.

Schumann, G. L. and Leonard, K. J., "Stem Rusts of Wheat," Plant Health Instructor, DOI: 10.1094/PHI-I-2000-0721-01, 2011, pp. unpaginated.

Vergauwen, D. and De Smet, I., "From early farmers to Norman Borlaug—the making of modern wheat," Curr. Biol. vol. 27, Sep. 11, 2017, pp. R858-R862.

* cited by examiner

>SR22
MAEVLVSASTGAMGSLLRKLGAMLTDEYKLLKNVRGDIKFLKDELEVMCAFLLKMSDVEEPDEPTKLRVTAVREMSYKI
EDNIDKFMVLVEQEHGSSCSEAAHGVAKLMDKCKNLLPDIKARRRIAKEVKDIKKEIKDVSDRFSRYKIDDSSSSMPAK
DKVDPRLRAVYKDAAELVGIDGPKDELVKWLNEKEGQSLKSVSIVGYGGLGKTTLANQIRVNLGATFDCGAFVSISRKP
DMKAILRSILSQITKKDDACSRLDDIQLIIDKIREFLQDTRYFIIDDIWELGTWETLKCAFVKNTLGSRIIITTRIVD
VAKSCSPSSEDLVYEMKPLSEADSKKLFFKRIFGCEESCPDSLKEAANDILKKCRGLPLAINAISSVLVTTRETKEEWD
RVRHSIRSSKVKSDIIETMNYILSLSYFDLPHHLRSCLLYLALFPEDQLIGRKRLVRRWISEGFIHGESGQDLMELGEE
YFHQLVNRSLIQPGNIGYDGKAMYCRVHDTILDFLIDKSSEENMCTVLKKQCKPNGIVRRLSLMGNEDEEIVEQLDLSH
ARSITAFGDIKLLPSLGRSKCLRVLDLQDCDQLENHHIKDIERLYQLRYLDISSTGITELPRQIGELLYLETLVAYGLR
*ELPESTSRLQRLARLFVYSGCKLPGGLGNLINLQELDCVDALHLKHVEELGKLTNLRKLSIKLDTGGIEGNKLEESKEK*
*LVSSLCKLDECGLLSLSIDYYLREKDGEEPFLPALGCIQEVFVYGQDISRISRWLASLPNLHRLLLDDPKIEQQDIEMI*
*GLIPNLIDLTLPPLYKTDDAGRLIIRREGFQQLQKFEAYNTRMGVLMFEPGAMPRLKELKLHNFIEKPKSAAVDFDFGI*
QRLSSLARLTVSLSCGGWTVAEVEAAEDAFKSMAEANPNRPILEMTRYNTQHMLQDEQIGMTGSATTPAVKS

MAEFVVRPLVSTLMNTASSYLLDQYKVMDGMKEQRETLKRQLPAILDIIQDAEKKGASLPGVRAWLEALKKVAYEANDV
FDEFKYEALRRDAKKKGHYKKLGFDIVSLFPAHNPIVFRYRMGKKLCRIVRKIEGLVREMNDFGFNQTQQAPPSKQWRN
TDSIIDSEKDIVSRSRNEEKKIVDILIDQAGDRDLIVLPIVGMGGLGKTTFAQLVYNDPIIKEHFKLQRWCCVSDDF
DVVKIANNICETNEIHREKALQNLQKEVSGKRYLIVLDDVWNEDADKWEKLKTCLKHGGKGSAILTTTRNVQVARIMKM
CIADSHNLRNLDKVFLKEIFENRAFCLQKPKAAELSDVVDKIMDRCGGSPLAAKAFGSMLSNKTSMKEWTDILARSNTC
NEGTKTFLVLKLSYDDLPSHLKQCFAFCAVFPKDYEIGVETLIQLWMAHDFIPLKEGDNLEKVGREIFDELTWRSFFQD
VKRIPRREWGELRPRTICKIHDLMHDIALSVMGKDCLTIVDRPNEKELLSTGPTRYLFSSYEYIGTLLDDYLKKHSPA
LQTLLYPYPYTSDSAPHLSKCNYLRALQLFSLRKLPLWPRHLQHLRYLDLSNNMLIEELPKEISILYNLQTLNLCNCRR
LDQLPEDMKYMENLRHLYTNGCSSLKCMPPGLGQLTSLQTLTYFVVSSSPGCSTIRELQDLNLGGELELSLRLQFATEVD
AKACSLGNKEKLTHLSLKWGDDSSDELGHHRNVLDALKPHAVLEFLRIRSYRGTGFPAWVSINFLQHLTELQLDGCTM
CEEFPQFGQFKSLEVLVLKRLNKLQSLCNHSSSAIFPALKVLRLKKLEIFERWATEGEELAFPQLENVKIKDCPKLAI
LPEAPKLKFIALKEEKAQLSLSIFKSRYMACLSGVGLSVRDTEAAPRTELDQDCEVSLSNLLLDGCNFLFCSTPLQPTV
GVWKWFGQLVHLEIKSCDMLIYWPEEEFRCLVSLNSLSINSCSKLVGHTQGKGCRTRTQVRDQLLPNLKNLRIHHCGSL
TELFVLPPSLTSIDMLDCNSIESILGQDDTELESILHFDTASSSEHFNDLTSTCLLEQSLSPRINPLPCLDYLRIVSCK
KLRFVPVQLDALQFLCISDCNGLESLDCLGDLPSLEYLYLMGCKHLASVPGSLGSYSALQKLRIEYCPALNMKPLHGHL
QQRLDSLELKDLSKAGSSHPNEGPKLWEPKSWKYMIPSLRKRESE

FIG. 9

| | | |
|---|---|---|
| PI573523 | MAEVLVSASTGAMGSLLRKLGAMLTDEYKLLKNVRGDIKFLKDELEVMCAFLLKMSDVEE | 60 |
| IG44878 | MAEVLVSASTGAMGSLLRKLGAMLTDEYKLLKNVRGDIKFLKDELEVMCAFLLKMSDVEE | 60 |
| DV92 | MAEVLVSASTGAMGSLLRKLGAMLTDEYKLLKNVRGDIKFLKDELEVMCAFLLKMSDVEE | 60 |
| PI289605 | MAEVLVSASTGAMGSLLRKLGAMLTDEYKLLKNVRGDIKFLKDELEVMCAFLLKMSDVEE | 60 |
| PI330550 | MAEVLVSASTGAMGSLLRKLGAMLTDEYKLLKNVRGDIKFLKDELEVMCAFLLKMSDVEE | 60 |
| PI190945 | MAEVLVSASTGAMGSLLRKLGAMLTDEYKLLKNVRGDIKFLKDELEVMCAFLLKMSDVEE | 60 |
| W3534 | MAEVLVSASTGAMGSLLRKLGAMLTDEYKLLKNVRGDIKFLKDELEVMCAFLLKMSDVEE | 60 |
| IG44857 | MAEVLVSASTGAMGSLLRKLGAMLTDEYKLLKNVRGDIKFLKDELEVMCAFLLKMSDVEE | 60 |
| IG44921 | MAEVLVSASTGAMGSLLRKLGAMLTDEYKLLKNVRGDIKFLKDELEVMCAFLLKMSDVEE | 60 |
| IG44855 | MAEVLVSASTGAMGSLLRKLGAMLTDEYKLLKNVRGDIKFLKDELEVMCAFLLKMSDVEE | 60 |
| Schomburgk | MAEVLVSASTGAMGSLLRKLGAMLTDEYKLLKNVRGDIKFLKDELEVMCAFLLKMSDVEE | 60 |
| PI355523 | MAEVLVSASTGAMGSLLRKLGAMLTDEYKLLKNVRGDIKFLKDELEVMCAFLLKMSDVEE | 60 |
| PI272557 | MAEVLVSASTGAMGSLLRKLGAMLTDEYKLLKNVRGDIKFLKDELEVMCAFLLKMSDVEE | 60 |
| Westonia | MAEVLVSASTGAMGSLLRKLGAMLTDEYKLLKNVRGDIKFLKDELEVMCAFLLKMSDVEE | 60 |
| | ************************************************************ | |

FIG. 10A

| | | |
|---|---|---|
| PI573523 | PDEPTKLRVTAVREMSYKIEDNIDKFMVLVEHES--SCSEAAHGVAKLMDKCKNLLPDIK | 118 |
| IG44878 | PDEPTKLRVTAVREMSYKIEDNIDKFMVLVEHES--SFSEAAHGVAKLMDKCKNLLPDIK | 118 |
| DV92 | PDEPTKLRVTAVREMSYKIEDNIDKFMVLVEHES--SSSE-AHGVTKLMDKCKNLLPDIK | 117 |
| PI289605 | PDEPTKLRVTAVREMSYKIEDNIDKFMVLVEQEHGSSCSEAAHGVAKLMDKCKNLLPDIK | 120 |
| PI330550 | PDEPTKLRVTAVREMSYKIEDNIDKFMVLVEQEHGSSCSEAAHGVAKLMDKCKNLLPDIK | 120 |
| PI190945 | PDEPTKLRVTAVREMSYKIEDNIDKFMVLVEHES--SCSEAAHGVAKLMDKCKNLLPDIK | 118 |
| W3534 | PDEPTKLRVTAVREMSYKIEDNIDKFMVLVEHES--SCSEAAHGVAKLMDKCKNLLPDIK | 118 |
| IG44857 | PDEPTKLRVTAVREMSYKIEDNIDKFMVLVEHES--SCSEAAHGVAKLMDKCKNLLPDIK | 118 |
| IG44921 | PDEPTKLRVTAVREMSYKIEDNIDKFMVLVEHES--SCSEAAHGVAKLMDKCKNLLPDIK | 118 |
| IG44855 | PDEPTKLRVTAVREMSYKIEDNIDKFMVLVEHGS--SCSEAAHGVAKLMDKCKNLLPDIK | 118 |
| Schomburgk | PDEPTKLRVTAVREMSYKIEDNIDKFMVLVEQEHGSSCSEAAHGVAKLMDKCKNLLPDIK | 120 |
| PI355523 | PDEPTKLRVTAVREMSYKIEDNIDKFMVLVEQEHGSSCSEAAHGVAKLMDKCKNLLPDIK | 120 |
| PI272557 | PDEPTKLRVTAVREMSYKIEDNIDKFMVLVEHES--SCSEAAHGVAKLMDKCKNLLPDIK | 118 |
| Westonia | PDEPTKLRVTAVREMSYKIEDNIDKFMVLVEHES--SCSEAAHGVAKLMDKCKNLLPDIK | 118 |
| | ************************************ *  * **** :: ************************ | |

FIG. 10B

| | | |
|---|---|---|
| PI573523 | TRRRIAKEVKDIKKEIKDVSDRFSRYKIDESSSSSMP-AKGKVDPRLRAVYKDAAELVGID | 177 |
| IG44878 | TRRRIAKEVKDIKKEIKDVSDRFSRYKIDESSSSSMP-AKGKVDPRLRAVYKDAAELVGID | 177 |
| DV92 | TRRRIAKEVKDIKKEIKDVSDRFLRYKIDDSSSSSMPAAKDKVDPRLRAVYKDAAELVGID | 179 |
| PI289605 | ARRRIAKEVKDIKKEIKDVSDRFSRYKIDDSSSSSMP-AKDKVDPRLRAVYKDAAELVGID | 177 |
| PI330550 | ARRRIAKEVKDIKKEIKDVSDRFSRYKIDDSSSSSSMP-AKDKVDPRLRAVYKDAAELVGID | 179 |
| PI190945 | TRRRIAKEVKDIKKEIKDVSDRFSRYKIDESSSSSMP-AKGKVDPRLRAVYKDAAELVGID | 177 |
| W3534 | TRRRIAKEVKDIKKEIKDVSDRFSRYKIDESSSSSMP-AKGKVDPRLRAVYKDAAELVGID | 177 |
| IG44857 | TRRRIAKEVKDIKKEIKDVSDRFSRYKIDESSSSSMP-AKGKVDPRLRAVYKDAAELVGID | 177 |
| IG44921 | TRRRIAKEVKDIKKEIKDVSDRFSRYKIDDSSSSSMP-AKDKVDPRLRAVYKDAAELVGID | 177 |
| IG44855 | ARRRIAKEVKDIKKEIKDVSDRFSRYKIDDSSSSSMP-AKDKVDPRLRAVYKDAAELVGID | 177 |
| Schomburgk | ARRRIAKEVKDIKKEIKDVSDRFSRYKIDDSSSSSSMP-AKDKVDPRLRAVYKDAAELVGID | 179 |
| PI355523 | ARRRIAKEVKDIKKEIKDVSDRFSRYKIDDSSSSSSMP-AKGKVDPRLRAVYKDAAELVGID | 179 |
| PI272557 | TRRRIAKEVKDIKKEIKDVSDRFSRYKIDESSSSSMP-AKGKVDPRLRAVYKDAAELVGID | 177 |
| Westonia | TRRRIAKEVKDIKKQIKDVSDRFSRYKIDESSSSSMP-AKEKVDPRLRAVYKDVTELVGID | 177 |
| | :********** :* ******..:.*..:.*** *************** | |

FIG. 10C

| | |
|---|---|
| PI573523 | GPKDELVKWLNEKEGQSLKSVSIVGYGGLGKTTLANQIRVNLGATFDCGAFVSISRKPDM 237 |
| IG44878 | GPKDELVKWLNEKEGQSLKSVSIVGYGGLGKTTLANQIRVNLGATFDCGAFVSISRKPDM 237 |
| DV92 | GPKDELVKWLNEKEGQSLKSVSIVGYGGLGKTTLANQIRVNLGATFDCGAFVSISRKPDM 237 |
| PI289605 | GPKDELVKWLNEKEGQSLKSVSIVGYGGLGKTTLANQIRVNLGATFDCGAFVSISRKPDM 239 |
| PI330550 | GPKDELVKWLNEKEGQSLKSVSIVGYGGLGKTTLANQIRVNLGATFDCGAFVSISRKPDM 239 |
| PI190945 | GPKDELVKWLNEKEGQSLKSVSIVGYGGLGKTTLANQIRVNLGATFDCGAFVSISRKPDM 237 |
| W3534 | GPKDELVKWLNEKEGQSLKSVSIVGYGGLGKTTLANQIRVNLGATFDCGAFVSISRKPDM 237 |
| IG44857 | GPKDELVKWLNEKEGQSLKSVSIVGYGGLGKTTLANQIRVNLGATFDCGAFVSISRKPDM 237 |
| IG44921 | GPKDELVKWLNEKEGQSLKSVSIVGYGGLGKTTLANQIRVNLGATFDCGAFVSISRKPDM 237 |
| IG44855 | GPKDELVKWLNEKEGQSLKSVSIVGYGGLGKTTLANQIRVNLGATFDCGAFVSISRKPDM 237 |
| Schomburgk | GPKDELVKWLNEKEGQSLKSVSIVGYGGLGKTTLANQIRVNLGATFDCGAFVSISRKPDM 239 |
| PI355523 | GPKDELVKWLNEKEGQSLKSVSIVGYGGLGKTTLANQIRVNLGATFDCGAFVSISRKPDM 239 |
| PI272557 | GPKDELVKWLNEKEGQSLKSVSIVGYGGLGKTTLANQIRVNLGATFDCGAFVSISRKPDM 237 |
| Westonia | GPKDELVKWLNEKEGQSLKSVSIVGYGGLGKTTLANQIRVNLRASFDCGAFVSISRKPDM 237 |
| | ****************************************** *.:************ |

FIG. 10D

```
PI573523      KAILRSILSQITKKDDACSRLDDIQLIIDKIREFLQDTRYFIIIDDIWELGTWETLKCAF  297
IG44878       KAILRSILSQITKKDDACSRLDDIQLIIDKIREFLQDTRYFIIIDDIWELGTWETLKCAF  297
DV92          KAILRSILSQITKKDEACPRLDDIQLIIDKIREFLQDTRYFIIIDDIWELGTWETLKCAF  297
PI289605      KAILRSILSQITKKDDACSRLDDIQLIIDKIREFLQDTRYFIIIDDIWELGTWETLKCAF  297
PI330550      KAILRSILSQITKKDDACSRLDDIQLIIDKIREFLQDTRYFIIIDDIWELGTWETLKCAF  299
PI190945      KAILRSILSQITKKDDACSRLDDIQLIIDKIREFLQDTRYFIIIDDIWELGTWETLKCAF  299
W3534         KAILRSILSQITKKDEACSRLDDIQLIIDKIREFLQDTRYFIIIDDIWELGTWETLKCAF  297
IG44857       KAILRSILSQITKKDEACSRLDDIQLIIDKIREFLQDTRYFIIIDDIWELGTWETLKCAF  297
IG44921       KAILRSILSQITKKDEACSRLDDIQLIIDKIREFLQDTRYFIIIDDIWELGTWETLKCAF  297
IG44855       KAILRSILSQITKKDDACSRLDDIQLIIDKIREFLQDTRYFIIIDDIWELGTWETLKCAF  297
Schomburgk    KAILRSILSQITKKDDACSRLDDIQLIIDKIREFLQDTRYFIIIDDIWELGTWETLKCAF  299
PI355523      KAILRSILSQITKKDDACSRLDDIQLIIDKIREFLQDTRYFIIIDDIWELGTWETLKCAF  299
PI272557      KAILRSILSQITKKDDACSRLDDIQLIIDKIREFLQDTRYFIIIDDIWELGTWETVKCAF  297
Westonia      KAILRSILSQITKKDDAYSRLDDIQLIIDKIREFLQDTRYFIIIDDIWELGTWETLKCAF  297
              ****************:*********.*************************:****
```

FIG. 10E

| | | |
|---|---|---|
| PI573523 | VKNTLGSRIIITTRIVDVAKSCSPSSEDLVYEMKPLSEADSKKLFFKRIFGCEESCPDSL | 357 |
| IG44878 | VKNTLGSRIIITTRIVDVAKSCSPSSEDLVYEMKPLSEADSKKLFFKRIFGCEESCPDSL | 357 |
| DV92 | VKNTLGSRIIITTRIVDVAKSCSPSSEDLVYEMKPLSEADSKKLFFKRIFGCEESCPDSL | 357 |
| PI289605 | VKNTLGSRIIITTRIVDVAKSCSPSSEDLVYEMKPLSEADSKKLFFKRIFGCEESCPDSL | 359 |
| PI330550 | VKNTLGSRIIITTRIVDVAKSCSPSSEDLVYEMKPLSEADSKKLFFKRIFGCEESCPDSL | 359 |
| PI190945 | VKNTLGSRIIITTRIVDVAKSCSPSSEDLVYEMKPLSEADSKKLFFKRIFGCEESCPDSL | 357 |
| W3534 | VKNTLGSRIIITTRIVDVAKSCSPSSEDLVYEMKPLSEADSKKLFFKRIFGCEESCPDSL | 357 |
| IG44857 | VKNTLGSRIIITTRIVDVAKSCSPSSEDLVYEMKPLSEADSKKLFFKRIFGCEESCPDSL | 357 |
| IG44921 | VKNTLGSRIIITTRIVDVAKSCSPSSEDLVYEMKPLSEADSKKLFFKRIFGCEESCPDSL | 357 |
| IG44855 | VKNTLGSRIIITTRIVDVAKSCSPSSEDLVYEMKPLSEADSKKLFFKRIFGCEESCPDSL | 357 |
| Schomburgk | VKNTLGSRIIITTRIVDVAKSCSPSSEDLVYEMKPLSEADSKKLFFKRIFGCEESCPDSL | 359 |
| PI355523 | VKNTLGSRIIITTRIVDVAKSCSPSSEDLVYEMKPLSEADSKKLFFKRIFGCEESCPDSL | 359 |
| PI272557 | VKNTLGSRIIITTRIVDVAKSCSPSSEDLVYEMKPLSEADSKKLFFKRIFGCEESCPDSL | 357 |
| Westonia | VKNTLGSRIIITTRIVDVAKSCSPSSEDLVYEMKPLSEADSKKLFFKRIFGCEESCPDSL | 357 |
| | ************************************************************ | |

FIG. 10F

| | |
|---|---|
| PI573523 | KEAANDILKKCRGLPLAINAISSLLVTTRETKEEWDRVRHSIRSSKVKSDIIETMNYILS 417 |
| IG44878 | KEAANDILKKCRGLPLAINAISSLLVTTRETKEEWDRVRHSIRSSKVKSDIIETMNYILS 417 |
| DV92 | KEAANDILKKCRGLPLAINAISSLLATTRETKEEWDRVRHSIRSSKVKSDIIETMNYILS 417 |
| PI289605 | KEAANDILKKCRGLPLAINAISSVLVTTRETKEEWDRVRHSIRSSKVKSDIIETMNYILS 419 |
| PI330550 | KEAANDILKKCRGLPLAINAISSVLVTTRETKEEWDRVRHSIRSSKVKSDIIETMNYILS 419 |
| PI190945 | KEAANDILKKCRGLPLAINAISSVLVTTRETKEEWDRVRHSIRSSKVKSDIIETMNYILS 417 |
| W3534 | KEAANDILKKCRGLPLAINAISSVLVTTRETKEEWDRVRHSIRSSKVKSDIIETMNYILS 417 |
| IG44857 | KEAANDILKKCRGLPLAINAISSVLVTTRETKEEWDRVRHSIRSSKVKSDIIETMNYILS 417 |
| IG44921 | KEAANDILKKCRGLPLAINAISSVLVTTRETKEEWDRVRHSIRSSKVKSDIIETMNYILS 417 |
| IG44855 | KEAANDILKKCRGLPLAINAISSVLVTTRETKEEWDRVRHSIRSSKVKSDIIETMNYILS 419 |
| Schomburgk | KEAANDILKKCRGLPLAINAISSVLVTTRETKEEWDRVRHSIRSSKVKSDIIETMNYILS 419 |
| PI355523 | KEAANDILKKCRGLPLAINAISSLLVTTRETKEEWDRVRHSIRSSKVKSDIIETMNYILS 417 |
| PI272557 | KEAANDILKKCRGLPLAINAISSLLATTRETKEEWDRVRHSIRSSKVKSDIIETMNYILS 417 |
| Westonia | KEAANDILKKCRGLPLAINAISSLLATTRETKEEWDRVRHSIHSSKVKSDIIETMNYILS 417 |
| | ***********************:\*:.\*\*\*\*\*\*\*\*\*\*\*\*\*:\*\*\*\*\*\*\*\*\*\*\*\*\*\*\*\*\*\*\* |

FIG. 10G

| | | |
|---|---|---|
| PI573523 | LSYFDLPHHLRSCLLYLALFPEDQLIGRKRLVRRWISEGFIHGESGQDLMELGEEYFHQL | 477 |
| IG44878 | LSYFDLPHHLRSCLLYLALFPEDQLIGRKRLVRRWISEGFIHGESGQDLMELGEEYFHQL | 477 |
| DV92 | LSYFDLPHHLRSCLLYLALFPEDQLIERKRLVRRWISEGFIHGESGQALMELGEEYFHQL | 477 |
| PI289605 | LSYFDLPHHLRSCLLYLALFPEDQLIGRKRLVRRWISEGFIHGESGQDLMELGEEYFHQL | 479 |
| PI330550 | LSYFDLPHHLRSCLLYLALFPEDQLIGRKRLVRRWISEGFIHGESGQDLMELGEEYFHQL | 479 |
| PI190945 | LSYFDLPHHLRSCLLYLALFPEDQLIGRKRLVRRWISEGFIHGESGQDLMELGEEYFHQL | 477 |
| W3534 | LSYFDLPHHLRSCLLYLALFPEDQLIGRKRLVRRWISEGFIHGESGQDLMELGEEYFHQL | 477 |
| IG44857 | LSYFDLPHHLRSCLLYLALFPEDQLIGRKRLVRRWISEGFIHGESGQDLMELGEEYFHQL | 477 |
| IG44921 | LSYFDLPHHLRSCLLYLALFPEDQLIGRKRLVRRWISEGFIHGESGQDLMELGEEYFHQL | 477 |
| IG44855 | LSYFDLPHHLRSCLLYLALFPEDQLIGRKRLVRRWISEGFIHGESGQDLMELGEEYFHQL | 479 |
| Schomburgk | LSYFDLPHHLRSCLLYLALFPEDQLIGRKRLVRRWISEGFIHGESGQDLMELGEEYFHQL | 479 |
| PI355523 | LSYFDLPHHLRSCLLYLALFPEDQLIGRKRLVRRWISEGFIHGESGQDLMELGEEYFHQL | 477 |
| PI272557 | LSYFDLPHHLRSCLLYLALFPEDQLIGRKRLVRRWISEGFIHGESGQDLMELGEEYFHQL | 477 |
| Westonia | LSYFDLPHHLRSCLLYLALFPEDQLIGRKRLVRRWISEGFIHGESGQDLMELGEEYFHQL | 477 |
| | ************************************************************ | |

FIG. 10H

| | | |
|---|---|---|
| PI573523 | VNRSLIQPGNIGYDGKAEYCRVHDTILDFLIDKSSEENMCTVLKKQCKPNGIVRRLSLMG | 537 |
| IG44878 | VNRSLIQPGNIGYDGKAKYCRVHDTILDFLIDKSSEENMCTVLKKQCKPNGIVRRLSLMG | 537 |
| DV92 | VNRSLIQPGNIGYDGKAEYCRVHDTILDFLIDKSSEENMCTVLKKQCKPNGIVRRLSLMG | 537 |
| PI289605 | VNRSLIQPGNIGYDGKAMYCRVHDTILDFLIDKSSEENMCTVLKKQCKPNGIVRRLSLMG | 539 |
| PI330550 | VNRSLIQPGNIGYDGKAMYCRVHDTILDFLIDKSSEENMCTVLKKQCKPNGIVRRLSLMG | 539 |
| PI190945 | VNRSLIQPGNIGYDGKAMYCRVHDTILDFLIDKSSEENMCTVLKKQCKPNGIVRRLSLMG | 537 |
| W3534 | VNRSLIQPGNIGYDGKAMYCRVHDTILDFLIDKSSEENMCTVLKKQCKPNGIVRRLSLMG | 537 |
| IG44857 | VNRSLIQPGNIGYDGKAMYCRVHDTILDFLIDKSSEENMCTVLKKQCKPNGIVRRLSLMG | 537 |
| IG44921 | VNRSLIQPGNIGYDGKAMYCRVHDTILDFLIDKSSEENMCTVLKKQCKPNGIVRRLSLMG | 537 |
| IG44855 | VNRSLIQPGNIGYDGKAMYCRVHDTILDFLIDKSSEENMCTVLKKQCKPNGIVRRLSLMG | 537 |
| Schomburgk | VNRSLIQPGNIGYDGKAMYCRVHDTILDFLIDKSSEENMCTVLKKQCKPNGIVRRLSLMG | 539 |
| PI355523 | VNRSLIQPGNIGYDGKAMYCRVHDTILDFLIDKSSEENMCTVLKKQCKPNGIVRRLSLMG | 539 |
| PI272557 | VNRSLIQPGNIGYDGKAKYCRVHDTILDFLIDKSSEENMCTVLKKQCKPNGIVRRLSLMG | 537 |
| Westonia | VNRSLIQPDYIGYDGKTEYCRVHDTILDFLIDKSSEENMCTVLKKQCKPNGIVRRLSLMG | 537 |
| | ******:.****..*.******************************* | |

FIG. 10I

| | | |
|---|---|---|
| PI573523 | NEDEEIMEQLDLSHARSISAFGDIKLLPSLGRSKCLRVLDLQGCYQLKNHHIKDIERLYQ | 597 |
| IG44878 | NEDEEIMEQLDLSHARSISAFGDIKLLPSLGRSKCLRVLDLQGCYQLKNHHIKDIERLYQ | 597 |
| DV92 | NEDEEIMEQLDLSHARSISAFGDIKLLPSLGRSKCLRVLDLQGCYQLKNHHIKDIERLYQ | 597 |
| PI289605 | NEDEEIVEQLDLSHARSITAFGDIKLLPSLGRSKCLRVLDLQDCDQLENHHIKDIERLYQ | 599 |
| PI330550 | NEDEEIVEQLDLSHARSITAFGDIKLLPSLGRSKCLRVLDLQDCDQLENHHIKDIERLYQ | 599 |
| PI190945 | NEDEEIVEQLDLSHARSITAFGDIKLLPSLGRSKCLRVLDLQDCDQLENHHIKDIERLYQ | 597 |
| W3534 | NEDEEIVEQLDLSHARSITAFGDIKLLPSLGRSKCLRVLDLQDCDQLENHHIKDIERLYQ | 597 |
| IG44857 | NEDEEIVEQLDLSHARSITAFGDIKLLPSLGRSKCLRVLDLQDCDQLENHHIKDIERLYQ | 597 |
| IG44921 | NEDEEIVEQLDLSHARSITAFGDIKLLPSLGRSKCLRVLDLQDCDQLENHHIKDIERLYQ | 597 |
| IG44855 | NEDEEIVEQLDLSHARSITAFGDIKLLPSLGRSKCLRVLDLQDCDQLENHHIKDIERLYQ | 597 |
| Schomburgk | NEDEETVEQLDLSHARSITAFGDIKLLPSLGRSKCLRVLDLQDCDQLENHHIKDIERLYQ | 599 |
| PI355523 | NEDEETVEQLDLSHARSITAFRDIKLLPSLGRSKCLRVLDLQACNQLENHHIKDIERLYQ | 599 |
| PI272557 | NEDEEIVEQLDLSHARSISAFGDIKLLPSLGRSKCLRVLDLQNCGQLRNHHIKDIERLYQ | 597 |
| Westonia | NEDEEIVEQLDLSHARSISAFGDIKLLPSLGRSKCLRVLDLQNCGQLRNHHIKDIERLYQ | 597 |
| | **:****:*.:*:*******************.*:*:********* | |

FIG. 10J

| | |
|---|---|
| PI573523 | LRYLDISFTGITELPRQIGELLYLETLVSTSYGLRELPESTSRLQRLARLFVDSGCKLPD 657 |
| IG44878 | LRYLDISFTGITELPRQIGELLYLETLVSTSYGLRELPESTSRLQRLARLFVDSGCKLPD 657 |
| DV92 | LRYLDISFTGITELPRQIGELLYLETLV--TSYGLRELPESTSRLQRLARLFVYHGCKLPD 656 |
| PI289605 | LRYLDISFTGITELPRQIGELLYLETLV--AYGLRELPESTSRLQRLARLFVYSGCKLPD 657 |
| PI330550 | LRYLDISSTGITELPRQIGELLYLETLV--AYGLRELPESTSRLQRLARLFVYSGCKLPD 657 |
| PI190945 | LRYLDISSTGITELPRQIGELLYLETLV--AYGLRELPESTSRLQRLARLFVYSGCKLPG 655 |
| W3534 | LRYLDISSTGITELPRQIGELLYLETLV--AYGLRELPESTSRLQRLARLFVYSGCKLPG 655 |
| IG44857 | LRYLDISSTGITELPRQIGELLYLETLV--AYGLRELPESTSRLQRLARLFVYSGCKLPG 655 |
| IG44921 | LRYLDISSTGITELPRQIGELLYLETLV--AYGLRELPESTSRLQRLARLFVYSGCKLPG 655 |
| IG44855 | LRYLDISSTGITELPRQIGELLYLETLV--AYGLRELPESTSRLQRLARLFVYSGCKLPG 655 |
| Schomburgk | LRYLDISSTGITELPRQIGELLYLETLV--AYGLRELPESTSRLQRLARLFVYSGCKLPG 657 |
| PI355523 | LRYLDISYTGITELPRQIGELLYLETLD--ASGLRELPESTSRLQRLARLFVDSGCKLPG 657 |
| PI272557 | LRYLDISFTGITELPRQIGELLYLETLV--TSYRLRELPESTSRLQRLARLFVDPGCKLPD 656 |
| Westonia | LRYLDISFTGITELPRQIGELLYLETLV--TSDGLRELPESTSRLQRLARLIVGCDCKLPD 656 |
| | ****:**************** :.:********** .*  **** . |

FIG. 10K

| | |
|---|---|
| PI573523 | GLGNLINLQELDCVDALQLKHVEELGKLTNLRKLRIKLDTDGIEGNKLEQSKEKLVSSLC 717 |
| IG44878 | GLGNLINLQELDCVDALQLKHVEELGKLTNLRKLRIKLDTDGIEGNKLEQSKEKLVSSLC 717 |
| DV92 | GLGNLVNLQELECVDALQLKHVEELGKLTNLRKLRIKLDTGGIEGNKLEESKEKLVSSLC 716 |
| PI289605 | GLGNLINLQELDCVDALHLKHVEELGKLTNLRKLSIKLDTGGIEGNKLEESKEKLVSSLC 717 |
| PI330550 | GLGNLINLQELDCVDALHLKHVEELGKLTNLRKLSIKLDTGGIEGNKLEESKEKLVSSLC 717 |
| PI190945 | GLGNLINLQELDCVDALHLKHVEELGKLTNLRKLSIKLDTGGIEGNKLEESKEKLVSSLC 715 |
| W3534 | GLGNLINLQELDCVDALHLKHVEELGKLTNLRKLSIKLDTGGIEGNKLEESKEKLVSSLC 715 |
| IG44857 | GLGNLINLQELDCVDALHLKHVEELGKLTNLRKLSIKLDTGGIEGNKLEESKEKLVSSLC 715 |
| IG44921 | GLGNLINLQELDCVDALHLKHVEELGKLTNLRKLSIKLDTGGIEGNKLEESKEKLVSSLC 715 |
| IG44855 | GLGNLINLQELDCVDALHLKHVEELGKLTNLRKLSIKLDTGGIEGNKLEESKEKLVSSLC 715 |
| Schomburgk | GLGNLINLQELDCVDALHLKHVEELGKLTNLRKLSIKLDTGGIEGNKLEESKEKLVSSLC 717 |
| PI355523 | GLGNLINLQELDCVDALQLKHVEELGKLTNLRKLRIKLDTGGIEGNKLEQSKEKLVSSLC 717 |
| PI272557 | GLGNLINLQELDWDALQLKHVEELGKLTNLRKLRIKLDTDGIEGNKLEQSKEKLVSSLC 716 |
| Westonia | GLGNLMNLQELDCVGALHLKHAEELGKLTNLRKLKINLYTHGIEGNKLEESKEKLVSSLC 716 |
|  | **::*.*.*:.**** ***** :*:: :*:********** |

FIG. 10L

```
PI573523      KLDECGLLSLSLSIYYYLREKDGEEPFLPALGCIQEVFVHGQDISRISRWLASLPNLHRLFL  777
IG44878       KLDECGLLSLSLSIYYYLREKDGEEPFLPALGCIQEVFVHGQDISRISRWLASLPNLHRLFL  777
DV92          KLDECGLRSLSLSIHYYLREKDGEEPFLPALGCIQEVCVYGQDISRISRWLASLPNLHRLFF  776
PI289605      KLDECGLLSLSLSIDYYLREKDGEEPFLPALGCIQEVFVYGQDISRISRWLASLPNLHRLFF  777
PI330550      KLDECGLLSLSLSIDYYLREKDGEEPFLPALGCIQEVFVYGQDISRISRWLASLPNLHGLLL  777
PI190945      KLDECGLLSLSLSIDYYLREKDGEEPFLPALGCIQEVFVYGQDISRISRWLASLPNLHGLLL  775
W3534         KLDECGLLSLSLSIDYYLREKDGEEPFLPALGCIQEVFVYGQDISRISRWLASLPNLHGLLL  775
IG44857       KLDECGLLSLSLSIDYYLREKDGEEPFLPALGCIQEVFVYGQDISRISRWLASLPNLHRLLL  775
IG44921       KLDECGLLSLSLSIDYYLREKDGEEPFLPALGCIQEVFVYGQDISRISRWLASLPNLHRLLL  775
IG44855       KLDECGLLSLSLSIDYYLREKDGEEPFLPALGCIQEVFVYGQDISRISRWLASLPNLHRLLL  775
Schomburgk    KLDECGLLSLSLSIDYYLREKDGEEPFLPALGCIQEVFVYGQDISRISRWLASLPNLHRLLL  777
PI355523      KLDECGLRSLSLSIRYYLREKDGEEPFLPALGCIQEVCVYGQDISRISRWLASLPNLHTLLL  777
PI272557      KLDECGLRSLSLSIGYYLREKDGEEPFLPPLGCIQEVSVYGQDISRISRWLASLPNLHMLFF  776
Westonia      KLDECGLRSLSIDYYLREKDGEEPFLPALGCIEEVFVYEQDISRISRWLASLPNLHRLVS   776
              ****** ** **  *  ***********  ****  * :*******************  *.
```

FIG. 10M

```
PI573523    NQP--KIEQQDIEMIGL--IPNLMDLTLY-LCITDDAG-RLIIKREGFQQLQRFELSRIRM 832
IG44878     NQP--KIEQQDIEMIALREPNLMDLTLY-LCITDDAG-RLIIKREGFQQLQRFELSRIRM 833
DV92        NDPKMKIEQQDIEMIGL--IPNLMDLTLY-LRITDDAMPRLIIKREGFQQLQRFELSRIRM 834
PI289605    DYP--KIEQQDIEMIGL--IPNLIDLTLY-LRITDDAG-RLIIKREGFQQLQRFELSRIRM 832
PI330550    DNP--KIEQQDIEMIGL--IPNLIDLTLY-LRITDDAG-RLIIKREGFQQLQRFELSRIRM 832
PI190945    DNP--KIEQQDIEMIGL--IPNLIDLTLY-LRITDDAG-RLIIKREGFQQLQRFELSRIRM 830
W3534       DNP--KIEQQDIEMIGL--IPNLIDLTLY-LRITDDAG-RLIIKREGFQQLQRFELSRIRM 830
IG44857     DDP--KIEQQDIEMIGL--IPNLIDLTLP PLYKTDDAG-RLIIRREGFQQLQKFEAYNTRM 831
IG44921     DDP--KIEQQDIEMIGL--IPNLIDLTLP PLYKTDDAG-RLIIRREGFQQLQKFEAYNTRM 831
IG44855     DDP--KIEQQDIEMIGL--IPNLIDLTLP PLYKTDDAG-RLIIRREGFQQLQKFEAYNTRM 831
Schomburgk  DDP--KIEQQDIEMIGL--IPNLIDLTLP PLYKTDDAG-RLIIRREGFQQLQKFEAYNTRM 833
PI355523    DYP--KIEQQDIEMIGL--IPNLIDLTLP-LYKTDDAG-RLIIRREGFQQLQKFEAYNTRM 832
PI272557    DYV--KIEQQDIEMIGL--IPNLIDLSLS-LRKTDDAG-RLIIRREGFQHLHSFRVVDTRM 831
Westonia    YDP--KIEQQDIEMIGL--IPNLIDLTLS-LPGTDDAG-RFIITREGFQQLQSFELSGSRM 831
                 ********* *******: * ****: ** :** **:.*: .*: **
```

FIG. 10N

| | | |
|---|---|---|
| PI573523 | GDLMFEPGAMPRLKELILYDFIGKPKSGAVDFDFGIQHLSSLARLTVGLSCVGSTVAEVE | 892 |
| IG44878 | GDLMFEPGAMPRLKELILYDFIGKPKSGAVDFDFGIQHLSSLARLTVGLSCVGSTVAEVE | 893 |
| DV92 | GDLMFEPGAMPRLKELILHNFIEKPKSGAVDFDFGIQHLSSLARLTVGLLCVGSTAAEVE | 894 |
| PI289605 | GDLMFEPGAMPRLKELILYHFIEKPKSGAVDFDFGIQHLSSLARLTVGLLCVGSTAAEVE | 892 |
| PI330550 | GDLMFEPGAMPRLKELILYHFIEKPKSGAVDFDFGIQHLSSLARLTVGLLCVGSTAAEVE | 892 |
| PI190945 | GDLMFEPGAMPRLKELILYHFIEKPKSGAVDFDFGIQHLSSLARLTVGLLCVGSTAAEVE | 890 |
| W3534 | GDLMFEPGAMPRLKELILYHFIEKPKSGAVDFDFGIQHLSSLARLTVGLLCVGSTAAEVE | 890 |
| IG44857 | GVLMFEPGAMPRLKELKLHNFIEKPKSAAVDFDFGIQRLSSLARLTVSLSCGGWTVAEVE | 891 |
| IG44921 | GVLMFEPGAMPRLKELKLHNFIEKPKSAAVDFDFGIQRLSSLARLTVSLSCGGWTVAEVE | 891 |
| IG44855 | GVLMFEPGAMPRLKELKLHNFIEKPKSAAVDFDFGIQRLSSLARLTVSLSCGGWTVAEVE | 891 |
| Schomburgk | GVLMFEPGAMPRLKELKLHNFIEKPKSAAVDFDFGIQRLSSLARLTVSLSCGGWTVAEVE | 893 |
| PI355523 | GVLMFEPGVMPRLKELKLHNFIEKPKSAAVDFDFGIQRLSSLARLTVDLSCVGWTVAEVE | 892 |
| PI272557 | GVLMFEPGAMPRLKELKLHNFIEKPESGAVDFDFGIQRLSSLARLTVSLFCVGSTAAEVE | 891 |
| Westonia | G-VLFEPGAMPRLKELILDDFIRKPKSAAVDFDFGIQRLSSLARLTVSLACYRSTAAEVE | 890 |
| | *  :: *. ****  * . .:  ******..******* *  *.**** | |

FIG. 10O

| | | |
|---|---|---|
| PI573523 | AAEDAFKSMAEANPNRPILEMTRYNTQHMLQDEQIGMTGSATTPAVKS | 940 |
| IG44878 | AAEDAFKSMAEANPNRPILEMTRYNTQHMLQDEQIGMTGSATTPAVKS | 941 |
| DV92 | AAEDAFKSMAEANPNRPILEMTRLCPQHMLQDEQIGMTGSATTPAVKS | 942 |
| PI289605 | AAEDAFKSMAEANPNRPILEMTRLYPQHMLQDEQIGMTGSATTPAVKS | 940 |
| PI330550 | AAEDAFKSMAEANPNRPILEMTRLYPQHMLQDEQIGMTGSATTPAVKS | 940 |
| PI190945 | AAEDAFKSMAEANPNRPILEMTRLYPQHMLQDEQIGMTGSATTPAVKS | 938 |
| W3534 | AAEDAFKSMAEANPNRPILEMTRLYPQHMLQDEQIGMTGSATTPAVKS | 938 |
| IG44857 | AAEDAFKSMAEANPNRPILEMTRYNTQHMLQDEQIGMTGSATTPAVKS | 939 |
| IG44921 | AAEDAFKSMAEANPNRPILEMTRYNTQHMLQDEQIGMTGSATTPAVKS | 939 |
| IG44855 | AAEDAFKSMAEANPNRPILEMTRYNTQHMLQDEQIGMTGSATTPAVKS | 939 |
| Schomburgk | AAEDAFKSMAEANPNRPILEMTRYNTQHMLQDEQIGMTGSATTPAVKS | 941 |
| PI355523 | AAEDAFKSMAEANPNRPILEMTRYNTQHMLQDEQIGMTGSATTPAVKS | 940 |
| PI272557 | ATEDAFKSMAEANPNRPILEMIRVNPHRMF-DEQIDMAGSATTPAVKS | 938 |
| Westonia | ATEDAFKSMAEANPNRPILEMTRLYPQHMVRDEQIDMAGSATTPAVKS | 938 |
| | *:********************* :* .:: :* ***********  | |

FIG. 10P

WHEAT STEM RUST RESISTANCE GENES AND METHODS OF USE

CROSS-REFERENCE TO RELATED APPLICATIONS

This application is the U.S. National Stage of International Application PCT/US2016/045390, filed Aug. 3, 2016, which designates the U.S and was published by the International Bureau in English on Feb. 9, 2017, and which claims the benefit of U.S. Provisional Patent Application No. 62/200,894, filed Aug. 4, 2015, all of which are whereby incorporated herein in their entirety by reference.

REFERENCE TO A SEQUENCE LISTING SUBMITTED AS A TEXT FILE

The official copy of the sequence listing is submitted electronically via EFS-Web as an ASCII formatted sequence listing with a file named 070294-0101SEQLST.TXT, created on Jul. 29, 2016, and having a size of 711 kilobytes, and is filed concurrently with the specification. The sequence listing contained in this ASCII formatted document is part of the specification and is herein incorporated by reference in its entirety.

FIELD OF THE INVENTION

The present invention relates to the fields of gene isolation and plant improvement, particularly to enhancing the resistance of plants to plant disease through the use of disease resistance genes.

BACKGROUND OF THE INVENTION

Plant diseases cause significant yield losses in world-wide wheat production. Among the most damaging diseases of wheat are the rusts. Wheat stem rust caused by *Puccinia graminis* f sp. *tritici* is one of the most devastating diseases affecting wheat production today. While wheat plants comprising resistance (R) genes against *Puccinia graminis* f. sp. *tritici* have proven effective in limiting the agronomic losses caused by wheat stem rusted, new races of *Puccinia graminis* f. sp. *tritici* have appeared recently for which the R genes are not effective. While pesticides can be used to control wheat stem rust, pesticides are expensive and at odds with the sustainable intensification of agriculture, and in developing countries, pesticides are simply unaffordable for subsistence farmers.

The sustainable intensification of agriculture will require increased use of genetic solutions instead of chemical solutions (e.g. pesticides) to protect crops against pathogens and pests (Jones et al. (2014) *Philos. T. Roy. Soc. B* 369: 20130087). Wild relatives of domesticated crops, such as wheat, contain an immense diversity of useful R genes that are a valuable resource for sustainable disease control. However, traditional methods for introducing R genes typically involve long breeding timelines to break linkage to deleterious alleles of other genes. Furthermore, R genes can be overcome within a few seasons when deployed one at a time (McDonald and Linde (2002) *Annu. Rev. Phytopathol.* 40:349-379). Molecular cloning, however, makes it possible to avoid linkage drag and simultaneously introduce multiple R genes (Dangl et al. (2013) *Science* 341:746-751), which should delay resistance-breaking pathogen race evolution and thus, provide more durable resistance (McDonald and Linde (2002) *Annu. Rev. Phytopathol.* 40:349-379).

While traditional map-based cloning methods have been employed to isolate R genes from plants, many plant genomes carry large chromosomal regions that are inaccessible to traditional map-based cloning due to suppressed recombination (Gaut et al. (2007) *Nature Rev. Genet.* 8:77-84) and wheat is no exception. Therefore, new, complementary approaches not relying on recombination need to be applied to identify additional R genes in crop plants and their undomesticated relatives.

BRIEF SUMMARY OF THE INVENTION

The present invention provides nucleic acid molecules for resistance (R) genes that are known to confer upon a plant resistance to at least one strain of the pathogen that causes wheat stem rust, *Puccinia graminis* f sp. *tritici*. In one embodiment, the present invention provides nucleic acid molecules comprising the R gene Sr22 and variants thereof including, for example, orthologs and non-naturally occurring variants. In another embodiment, the present invention provides nucleic acid molecules comprising the R gene Sr45 and variants thereof including, for example, orthologs and non-naturally occurring variants.

The present invention further provides plants, plant cells, and seeds comprising in their genomes one or more polynucleotide constructs of the invention. The polynucleotide constructs comprise a nucleotide sequence encoding a resistance (R) protein of the present invention. Such R proteins are encoded by the R genes of the present invention. In a preferred embodiment, the plants and seeds are transgenic wheat plants and seeds that have been transformed with one or more polynucleotide constructs of the invention. Preferably, such wheat plants comprise enhanced resistance to at least one strain of the pathogen that causes wheat stem rust, *Puccinia graminis* f sp. *tritici*, when compared to the resistance of a control wheat plant that does not comprise the polynucleotide construct.

The present invention provides methods for enhancing the resistance of a wheat plant to wheat stem rust. Such methods comprise introducing into at least one wheat plant cell a polynucleotide construct comprising a nucleotide sequence of an R gene of the present invention. In some embodiments, the polynucleotide construct or part thereof is stably incorporated into the genome of the plant cell, and in other embodiments, the polynucleotide construct is not stably incorporated into the genome of the wheat plant cell. The methods for enhancing the resistance of a wheat plant to wheat stem rust can optionally further comprise regenerating the wheat plant cell into a wheat plant that comprises in its genome the polynucleotide construct. Preferably, such a wheat plant comprises enhanced resistance to wheat stem rust caused by at least one race of *Puccinia graminis* f sp. *tritici*, relative to a control wheat plant.

The present invention additionally provides methods for identifying a wheat plant that displays newly conferred or enhanced resistance to wheat stem rust. The methods comprise detecting in the wheat plant the presence of at least one R gene selected from the group consisting of Sr22 and Sr45.

Methods of using the wheat plants of the present invention in agricultural crop production to limit wheat stem rust are also provided. The methods comprise planting a wheat seed produced by a wheat plant of the present invention, wherein the wheat seed comprises at least one R gene nucleotide sequence of the present invention. The methods further comprise growing a wheat plant under conditions favorable for the growth and development of the wheat plant, and optionally harvesting at least one seed from the wheat plant.

Additionally provided are plants, plant parts, seeds, plant cells, other host cells, expression cassettes, and vectors comprising one or more of the nucleic acid molecules of the present invention.

BRIEF DESCRIPTION OF THE DRAWINGS

FIG. 8. The amino acid sequence of SR22 from Schomburgk (SEQ ID NO: 2) The highlighted domains are the coiled-coil domain (bold; amino acids 120-147), the nucleotide-binding domain (underlined; amino acids 178-465) and the leucine-rich repeat domain (italics; amino acids 601-853) predicted using SMART (available on the world-wide web at smart.embl-heidelberg.de).

FIG. 9. The amino acid sequence of SR45 from CS1D5406 (SEQ ID NO: 50). The highlighted domains are the coiled-coil domain (bold; amino acids 32-55), the nucleotide-binding domain (underlined; amino acids 175-452) and the leucine-rich repeat domain (italics; amino acids 578-867) predicted using SMART (available on the world-wide web at smart.embl-heidelberg.de).

FIGS. 10A-10P. Multiple alignment of Sr22 amino acid sequences from the following diploid and hexaploid wheats: PI573523 (SEQ ID NO: 14), IG44878 (SEQ ID NO: 29), DV92 (SEQ ID NO: 38), PI289605 (SEQ ID NO: 8), PI330550 (SEQ ID NO: 11), PI190945 (SEQ ID NO: 5), W3534 (SEQ ID NO: 35), IG44857 (SEQ ID NO: 23), IG44921 (SEQ ID NO: 26), IG44855 (SEQ ID NO: 20), Schomburgk (SEQ ID NO: 2), PI355523 (SEQ ID NO: 17), PI272557 (SEQ ID NO: 32), and Westonia (SEQ ID NO: 41).

FIG. 11A shows the results for the susceptible cultivar Fielder transformed with construct PC103 comprising Sr22 from Schomburgk (*T. boeoticum*) with the native Sr22 5' and 3' regulatory elements. The picture shows six transgenic plants (numbered PC103-1, -2, -3, -4, -5, -6). All were found to be resistant to the Australian stem rust race 98-1,2,3,5 and 6, similar to the Sr22 response in cultivar Schomburgk (infection type 2-). In the image, lane 1 is Fielder (susceptible control), whereas lanes 2 to 7 are the transgenic lines 1 to 6, respectively.

FIG. 11B shows the results for the susceptible cultivar Fielder transformed with construct PC129 comprising Sr22 from PI190945 (*T. monococcum*) with the native 5' and 3' regulatory elements. A total of 13 transgenic plants were recovered and scored for resistance to the Australian stem rust race 98-1,2,3,5 and 6. Plant numbers PC129-1, -4, -6, -7, -8, -10, -11, -13 had a resistance similar to the Sr22 response in PI190945 (infection type 2-). Of these eight plants, PC129-1, -4, -6, -11, and -13 are shown in the image. One plant (PC129-9) had an infection type of 2 (slightly higher than PI190945), while three plants (PC129-2, -5 and -12) had an infection type of 2+(higher than PI190945). One plant (PC129-3) had an infection type of 3+, which is similar to Fielder.

FIG. 11C shows the results for the susceptible cultivar Fielder transformed with construct PC110 comprising Sr45 from *Aegilops tauschii* accession AUS18911 with the native 5' and 3' regulatory elements. A total of 12 transgenic plants were recovered and scored for resistance to the Australian stem rust race 98-1,2,3,5 and 6. Seven plants (PC110-1, -2, -4, -5, -7, -10, -12) had an infection type; 1 which is similar to Sr45 in AUS18911 and CS1D5406. Four plants (PC110-3, -6, -9, -11) had an infection type 1 (slightly higher than AUS18911). One plant (PC110-8) had an infection type of 3+ which is similar to Fielder.

FIGS. 11D-11E show results from transgenic plants comprising Sr22 from Schomburgk, Sr22 from PI190945 and Sr22 from PI573523 with native or non-native regulatory elements. The susceptible cultivar Fielder was transformed with the constructs PC126, PC127, PC128, PC130, PC131, PC132, PC146 and PC147. The promoter, coding region, and terminator for each construct is set forth in Table 6. For each construct ten transgenic plants were scored for resistance to the Australian stem rust race 98-1,2,3,5 and 6. In FIG. 11D, the plants derived from PC126, PC127, PC128, PC130, and PC132 were all resistant with infection types ranging from 1+ to 2, while the plants derived from PC131 were all susceptible with infection types of 3+. A representative plant for each construct is shown in the picture. In FIG. 11E, all plants derived from PC146 were highly susceptible, while the plants derived from PC147 (except line 9) produced infection type; 1 typical of the strong resistance reaction of Sr45.

SEQUENCE LISTING

Figure 1:
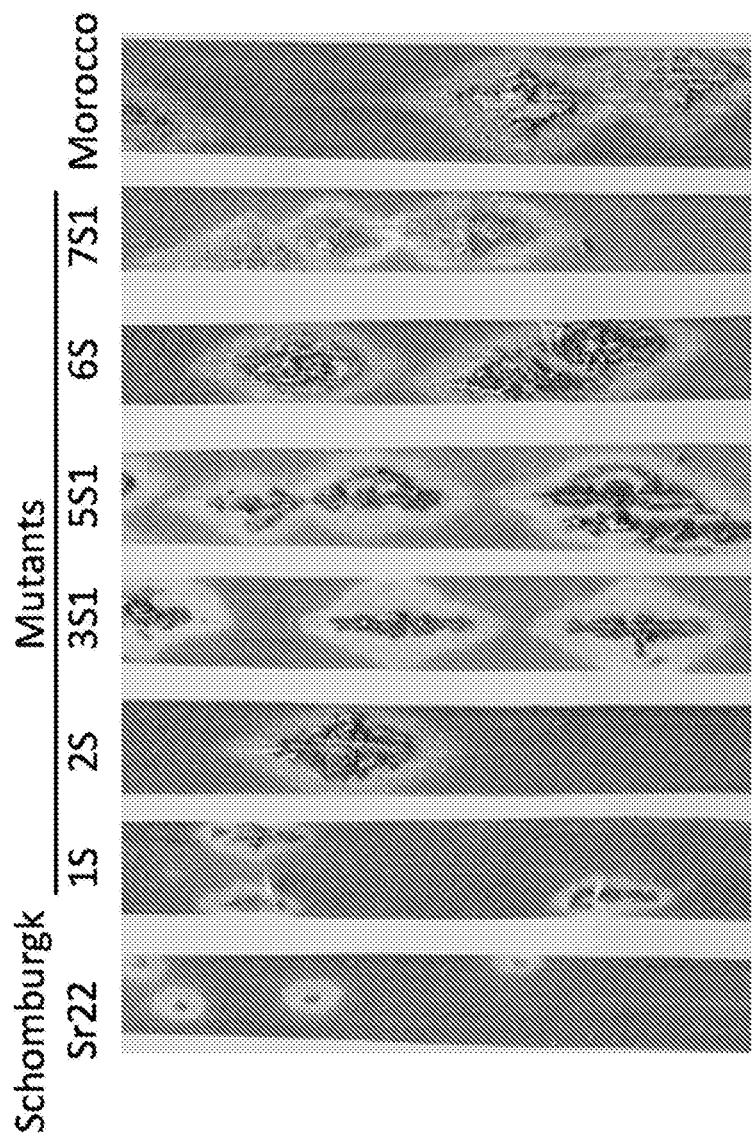
FIG. 1. Stem rust infection phenotype of Schomburgk (Sr22), EMS-induced susceptible mutants, and the susceptible check Morocco.

The nucleotide and amino acid sequences listed in the accompanying sequence listing are shown using standard letter abbreviations for nucleotide bases, and three-letter code for amino acids. The nucleotide sequences follow the standard convention of beginning at the 5' end of the sequence and proceeding forward (i.e., from left to right in each line) to the 3' end. Only one strand of each nucleotide sequence is shown, but the complementary strand is understood to be included by any reference to the displayed strand. The amino acid sequences follow the standard convention of beginning at the amino terminus of the sequence and proceeding forward (i.e., from left to right in each line) to the carboxy terminus.

SEQ ID NO: 1 sets forth the nucleotide sequence of the R gene, Sr22, from *T. aestivum* 'Schomburgk'.

SEQ ID NO: 2 sets forth the amino acid sequence of the R protein encoded by Sr22 from *T. aestivum* 'Schomburgk'.

SEQ ID NO: 3 sets forth the nucleotide sequence of the coding region of the cDNA of Sr22 from *T. aestivum* 'Schomburgk'. If desired, a stop codon (e.g. TAA, TAG, or TGA) can be operably linked to the 3' end of nucleic acid molecule comprising SEQ ID NO: 3.

SEQ ID NO: 4 sets forth the nucleotide sequence of the R gene, Sr22, from *T. monococcum* accession PI190945.

SEQ ID NO: 5 sets forth the amino acid sequence of the R protein encoded by Sr22 from *T. monococcum* accession PI190945.

SEQ ID NO: 6 sets forth the nucleotide sequence of the coding region of the cDNA of Sr22 from *T. monococcum* accession PI190945. If desired, a stop codon (e.g. TAA, TAG, or TGA) can be operably linked to the 3' end of nucleic acid molecule comprising SEQ ID NO: 6.

SEQ ID NO: 7 sets forth the nucleotide sequence of the R gene, Sr22, from *T. monococcum* accession PI289605.

SEQ ID NO: 8 sets forth the amino acid sequence of the R protein encoded by Sr22 from *T. monococcum* accession PI289605.

SEQ ID NO: 9 sets forth the nucleotide sequence of the coding region of the cDNA of Sr22 from *T. monococcum* accession PI289605. If desired, a stop codon (e.g. TAA, TAG, or TGA) can be operably linked to the 3' end of nucleic acid molecule comprising SEQ ID NO: 9.

SEQ ID NO: 10 sets forth the nucleotide sequence of the R gene, Sr22, from *T. monococcum* accession PI330550.

SEQ ID NO: 11 sets forth the amino acid sequence of the R protein encoded by Sr22 from *T. monococcum* accession PI330550.

SEQ ID NO: 12 sets forth the nucleotide sequence of the coding region of the cDNA of Sr22 from *T. monococcum* accession PI330550. If desired, a stop codon (e.g. TAA, TAG, or TGA) can be operably linked to the 3' end of nucleic acid molecule comprising SEQ ID NO: 12.

SEQ ID NO: 13 sets forth the nucleotide sequence of a resistance gene analogue from *T. monococcum* accession PI573523. This resistance gene analogue is an analogue of Sr22 from Schomburgk.

SEQ ID NO: 14 sets forth the amino acid sequence of the protein encoded by the resistance gene analogue comprising the nucleotide sequence set forth in SEQ ID NO: 13.

SEQ ID NO: 15 sets forth the nucleotide sequence of the coding region of the resistance gene analogue comprising the nucleotide sequence set forth in SEQ ID NO: 13. If desired, a stop codon (e.g. TAA, TAG, or TGA) can be operably linked to the 3' end of nucleic acid molecule comprising SEQ ID NO: 15.

SEQ ID NO: 16 sets forth the nucleotide sequence of a resistance gene analogue from *T. monococcum* accession PI355523. This resistance gene analogue is an analogue of Sr22 from Schomburgk.

SEQ ID NO: 17 sets forth the amino acid sequence of the protein encoded by the resistance gene analogue comprising the nucleotide sequence set forth in SEQ ID NO: 16.

SEQ ID NO: 18 sets forth the nucleotide sequence of the coding region of the resistance gene analogue comprising the nucleotide sequence set forth in SEQ ID NO: 16. If desired, a stop codon (e.g. TAA, TAG, or TGA) can be operably linked to the 3' end of nucleic acid molecule comprising SEQ ID NO: 18.

SEQ ID NO: 19 sets forth the nucleotide sequence of the R gene, Sr22, from *T. boeoticum* accession IG44855.

SEQ ID NO: 20 sets forth the amino acid sequence of the R protein encoded by Sr22 from *T. boeoticum* accession IG44855.

SEQ ID NO: 21 sets forth the nucleotide sequence of the coding region of the cDNA of Sr22 from *T. boeoticum* accession IG44855. If desired, a stop codon (e.g. TAA, TAG, or TGA) can be operably linked to the 3' end of nucleic acid molecule comprising SEQ ID NO: 21.

SEQ ID NO: 22 sets forth the nucleotide sequence of the R gene, Sr22 from *T. boeoticum*, accession IG44857.

SEQ ID NO: 23 sets forth the amino acid sequence of the R protein encoded by Sr22 from *T. boeoticum* accession IG44857.

SEQ ID NO: 24 sets forth the nucleotide sequence of the coding region of the cDNA of Sr22 from *T. boeoticum* accession IG44857. If desired, a stop codon (e.g. TAA, TAG, or TGA) can be operably linked to the 3' end of nucleic acid molecule comprising SEQ ID NO: 24.

SEQ ID NO: 25 sets forth the nucleotide sequence of the R gene, Sr22, from *T. boeoticum* accession IG44921.

SEQ ID NO: 26 sets forth the amino acid sequence of the R protein encoded by Sr22 from *T. boeoticum* accession IG44921.

SEQ ID NO: 27 sets forth the nucleotide sequence of the coding region of the cDNA of Sr22 from *T. boeoticum* accession IG44921. If desired, a stop codon (e.g. TAA, TAG, or TGA) can be operably linked to the 3' end of nucleic acid molecule comprising SEQ ID NO: 27.

SEQ ID NO: 28 sets forth the nucleotide sequence of a resistance gene analogue from *T. boeoticum* accession IG44878. This resistance gene analogue is an analogue of Sr22 from Schomburgk.

SEQ ID NO: 29 sets forth the amino acid sequence of the protein encoded by the resistance gene analogue comprising the nucleotide sequence set forth in SEQ ID NO: 28.

SEQ ID NO: 30 sets forth the nucleotide sequence of the coding region of the resistance gene analogue comprising the nucleotide sequence set forth in SEQ ID NO: 28. If desired, a stop codon (e.g. TAA, TAG, or TGA) can be operably linked to the 3' end of nucleic acid molecule comprising SEQ ID NO: 30.

SEQ ID NO: 31 sets forth the nucleotide sequence of a resistance gene analogue from *T. monococcum* accession PI272557. This resistance gene analogue is an analogue of Sr22 from Schomburgk.

SEQ ID NO: 32 sets forth the amino acid sequence of the protein encoded by the resistance gene analogue comprising the nucleotide sequence set forth in SEQ ID NO: 31.

SEQ ID NO: 33 sets forth the nucleotide sequence of the coding region of the resistance gene analogue comprising the nucleotide sequence set forth in SEQ ID NO: 31. If desired, a stop codon (e.g. TAA, TAG, or TGA) can be operably linked to the 3' end of nucleic acid molecule comprising SEQ ID NO: 33.

SEQ ID NO: 34 sets forth the nucleotide sequence of the R gene, Sr22, from *T. aestivum* accession W3534.

SEQ ID NO: 35 sets forth the amino acid sequence of the R protein encoded by Sr22 from *T. aestivum* accession W3534.

SEQ ID NO: 36 sets forth the nucleotide sequence of the coding region of the cDNA of Sr22 from *T. aestivum* accession W3534. If desired, a stop codon (e.g. TAA, TAG, or TGA) can be operably linked to the 3' end of nucleic acid molecule comprising SEQ ID NO: 36.

SEQ ID NO: 37 sets forth the nucleotide sequence of a resistance gene analogue from *T. monococcum* accession DV92. This resistance gene analogue is an analogue of Sr22 from Schomburgk.

SEQ ID NO: 38 sets forth the amino acid sequence of the protein encoded by the resistance gene analogue comprising the nucleotide sequence set forth in SEQ ID NO: 37.

SEQ ID NO: 39 sets forth the nucleotide sequence of the coding region of the resistance gene analogue comprising the nucleotide sequence set forth in SEQ ID NO: 37. If desired, a stop codon (e.g. TAA, TAG, or TGA) can be operably linked to the 3' end of nucleic acid molecule comprising SEQ ID NO: 39.

SEQ ID NO: 40 sets forth the nucleotide sequence of a resistance gene analogue from *T. aestivum* 'Westonia'. This resistance gene analogue is an analogue of Sr22 from Schomburgk.

SEQ ID NO: 41 sets forth the amino acid sequence of the protein encoded by the resistance gene analogue comprising the nucleotide sequence set forth in SEQ ID NO: 40.

SEQ ID NO: 42 sets forth the nucleotide sequence of the coding region of the resistance gene analogue comprising the nucleotide sequence set forth in SEQ ID NO: 40. If desired, a stop codon (e.g. TAA, TAG, or TGA) can be operably linked to the 3' end of nucleic acid molecule comprising SEQ ID NO: 42.

SEQ ID NO: 43 sets forth the nucleotide sequence of the 2S mutant of Sr22 from *T. aestivum* 'Schomburgk'.

SEQ ID NO: 44 sets forth the nucleotide sequence of the 7S1 mutant of Sr22 from *T. aestivum* 'Schomburgk'.

SEQ ID NO: 45 sets forth the nucleotide sequence of the 1S mutant of Sr22 from *T. aestivum* 'Schomburgk'.

SEQ ID NO: 46 sets forth the nucleotide sequence of the 3S1 mutant of Sr22 from *T. aestivum* 'Schomburgk'.

SEQ ID NO: 47 sets forth the nucleotide sequence of the 5S1 mutant of Sr22 from *T. aestivum* 'Schomburgk'.

SEQ ID NO: 48 sets forth the nucleotide sequence of the 6S mutant of Sr22 from *T. aestivum* 'Schomburgk'.

SEQ ID NO: 49 sets forth the nucleotide sequence of the R gene, Sr45, from *Aegilops tauschii* accession AUS18911.

SEQ ID NO: 50 sets forth the amino acid sequence of the R protein encoded by Sr45 from *Aegilops tauschii* accession AUS18911.

SEQ ID NO: 51 sets forth the nucleotide sequence of the coding region of the cDNA of Sr45 from *Aegilops tauschii* accession AUS18911. If desired, a stop codon (e.g. TAA, TAG, or TGA) can be operably linked to the 3' end of nucleic acid molecule comprising SEQ ID NO: 51.

SEQ ID NO: 53 sets forth the nucleotide sequence of the 52S1 mutant of *T. aestivum* substitution line CS1D5406.

SEQ ID NO: 53 sets forth the nucleotide sequence of the 57S1 mutant of *T. aestivum* substitution line CS1D5406.

SEQ ID NO: 54 sets forth the nucleotide sequence of the 59S1 mutant of *T. aestivum* substitution line CS1D5406.

SEQ ID NO: 55 sets forth the nucleotide sequence of the 49S1 mutant of *T. aestivum* substitution line CS1D5406.

SEQ ID NO: 56 sets forth the nucleotide sequence of the 55S1 mutant of *T. aestivum* substitution line CS1D5406.

SEQ ID NO: 57 sets forth the nucleotide sequence of the 61S1 mutant of *T. aestivum* substitution line CS1D5406.

SEQ ID NOS: 58-137 are oligonucleotide sequences that are described below in the Examples.

SEQ ID NO: 138 sets forth the nucleotide sequence of the promoter maize ubiquitin construct that is described in Example 13.

SEQ ID NO: 139 sets forth the nucleotide sequence of the promoter Sr33 native construct derived from Sr33 of from *Aegilops tauschii* that is described in Example 13.

SEQ ID NO: 140 sets forth the nucleotide sequence of a promoter PI190945 native construct derived from Sr22 of *T. monococcum* accession PI190945 that is described in Example 13.

SEQ ID NO: 141 sets forth the nucleotide sequence of coding region-1 Sr22 locus construct derived from Sr22 of *T. aestivum* 'Schomburgk' that is described in Example 13.

SEQ ID NO: 142 sets forth the nucleotide sequence of coding region-2 Sr22 locus domesticated BsaI construct derived from Sr22 of *T. aestivum* 'Schomburgk' that is described in Example 13.

SEQ ID NO: 143 sets forth the nucleotide sequence of coding region-1 PI190945 construct derived from Sr22 of *T. monococcum* accession PI190945 that is described in Example 13.

SEQ ID NO: 144 sets forth the nucleotide sequence of coding region-2 PI190945 domesticated BsaI construct derived from Sr22 locus of *T. monococcum* accession PI190945 that is described in Example 13.

SEQ ID NO: 145 sets forth the nucleotide sequence of coding region-1 PI573523 construct derived from Sr22 of *T. monococcum* accession PI573523 that is described in Example 13.

SEQ ID NO: 146 sets forth the nucleotide sequence of coding region-2 PI573523 domesticated BsaI construct derived from Sr22 of *T. monococcum* accession PI573523 that is described in Example 13.

SEQ ID NO: 147 sets forth the nucleotide sequence of the terminator Sr33 native construct derived from Sr33 of *Aegilops tauschii* that is described in Example 13.

SEQ ID NO: 148 sets forth the nucleotide sequence of the terminator Schomburgk domesticated BsaI construct construct derived from Sr22 of *T. aestivum* 'Schomburgk' that is described in Example 13.

SEQ ID NO: 149 sets forth the nucleotide sequence of the terminator PI190945 domesticated BsaI construct construct derived from Sr22 of *T. monococcum* accession PI190945 that is described in Example 13.

SEQ ID NO: 150 sets forth the nucleotide sequence of the coding region Sr45 locus domesticated BsaI construct derived from Sr45 of *Aegilops tauschii* accession AUS18911 that is described in Example 13.

SEQ ID NO: 151 sets forth the nucleotide sequence of the whole gene Sr33 promoter Sr22 coding region Sr33 native terminator construct that is described in Example 13.

SEQ ID NOS: 152-162 set forth the nucleotide sequences of the constructs that are described below in Table 6.

SEQ ID NO: 163 sets forth the nucleotide sequence of binary vector pVecBARII, which is also referred to as VecBARII.

DETAILED DESCRIPTION OF THE INVENTION

The present inventions now will be described more fully hereinafter with reference to the accompanying drawings, in which some, but not all embodiments of the inventions are shown. Indeed, these inventions may be embodied in many different forms and should not be construed as limited to the embodiments set forth herein; rather, these embodiments are provided so that this disclosure will satisfy applicable legal requirements. Like numbers refer to like elements throughout.

Many modifications and other embodiments of the inventions set forth herein will come to mind to one skilled in the art to which these inventions pertain having the benefit of the teachings presented in the foregoing descriptions and the associated drawings. Therefore, it is to be understood that the inventions are not to be limited to the specific embodiments disclosed and that modifications and other embodiments are intended to be included within the scope of the appended claims. Although specific terms are employed herein, they are used in a generic and descriptive sense only and not for purposes of limitation.

The present invention relates to the isolation of plant resistance (R) genes, particularly R genes that confer upon a wheat plant resistance to wheat stem rust caused by *Puccinia graminis* f sp. *tritici*. As disclosed hereinbelow, a three-step method for the rapid cloning of R genes was used to isolate the R genes, Sr22 and Sr45. The method, which is known as "RenSeq+EMS", involves (i) chemical mutagenesis and screening for susceptible mutants, (ii) exome capture and next-generation sequencing, followed by (iii) sequence comparison of wild-type and mutants. The RenSeq+EMS method is disclosed in U.S. patent application Ser. No. 14/667,116 and International Patent Application PCT/US2015/016792, both filed on Feb. 20, 2015.

The present invention provides nucleic acid molecules comprising the nucleotide sequences of R genes, particularly the nucleotide sequence of Sr22 and Sr45 and naturally occurring (e.g. orthologs and allelic variants) and synthetic or artificial (i.e. non-naturally occurring) variants thereof. Such nucleotide sequences of R genes, which are also referred to herein as R gene nucleotide sequences, encode R proteins. R gene nucleotide sequences of the invention include, but not limited to, wild-type R genes comprising a native promoter and the 3' adjacent region comprising the coding region, cDNA sequences, and nucleotide sequences comprising only the coding region. Examples of such R gene nucleotide sequences include the nucleotide sequences set forth in SEQ ID NOS: 1, 3, 4, and 6 and variants thereof. In embodiments in which the native R gene promoter is not used to drive the expression of the nucleotide sequence encoding the R protein, a heterologous promoter can be operably linked to a nucleotide sequence encoding an R protein of the invention to drive the expression of nucleotide sequence encoding an R protein in a plant.

Preferably, the R proteins of the invention are functional R proteins that are capable of conferring on a wheat plant comprising the R protein enhanced resistance to wheat stem rust caused by at least one race of *Puccinia graminis* f. sp. *tritici*. In certain embodiments, the R proteins of the present invention comprise broad-spectrum resistance to multiple races of *Puccinia graminis* f sp. *tritici* such as, for example, the R proteins encoded by Sr22 and Sr45.

The present invention further provides transgenic plants comprising a polynucleotide construct which comprise an R gene nucleotide sequence of the invention. In some embodiments, the polynucleotide construct is stably incorporated into the genome of the plant, and in other embodiments, the plant is transformed by a transient transformation method and the polynucleotide construct is not stably incorporated into the genome of the plant. Methods for both the stable and transient transformation of plants are disclosed elsewhere herein or otherwise known in the art. In a preferred embodiment of the invention, the transgenic plants are wheat plants that comprise enhanced resistance to wheat stem rust caused by at least one race of *Puccinia graminis* f. sp. *tritici*.

In certain embodiments, a transgenic plant of the invention comprises a polynucleotide construct comprising a nucleotide sequence encoding an R protein and a heterologous promoter that is operably linked for expression of the nucleotide sequence encoding an R protein. The choice of heterologous promoter can depend on a number of factors such as, for example, the desired timing, localization, and pattern of expression as well as responsiveness to particular biotic or abiotic stimulus. Promoters of interest include, but are not limited to, pathogen-inducible, constitutive, tissue-preferred, wound-inducible, and chemical-regulated promoters.

In certain embodiments of the invention, the transgenic plant, particularly a transgenic wheat plant, can comprise one, two, three, four, five, six, or more nucleotide sequences encoding an R protein. Typically, but not necessarily, the two or more R proteins will be different from each other. For the present invention, an R protein is different from another R protein when the two R proteins have non-identical amino acid sequences. In certain embodiments of the invention, each of the different R proteins for wheat stem rust has one or more differences in resistance characteristics such as, for example, resistance against a different race and/or group of races of *Puccinia graminis* f. sp. *tritici*. It is recognized that by combining two, three, four, five, six, or more nucleotide sequences with each nucleotide sequence encoding a different R protein for wheat stem rust, a wheat plant can be produced that comprises broad spectrum resistance against multiple races of *Puccinia graminis* f sp. *tritici*. Such a wheat plant finds use in agriculture in regions where multiple races of *Puccinia graminis* f sp. *tritici* are known to occur.

Examples of wheat stem rust R genes that can be combined in a single wheat plant with an Sr22 and/or Sr45 nucleotide sequence of the present invention include Sr26, Sr32, Sr33 (GenBank Accession No. KF031299.1), Sr35 (GenBank Accession No. KC573058.1), Sr39, Sr40, Sr47, Sr50, and the adult plant resistance gene Sr57/Lr34 (GenBank Accession No. FJ436983.1) and Sr55/Lr67.

A transgenic plant of the invention comprising multiple R genes can be produced by transforming a plant that already comprises one or more other R gene nucleotide sequences with a polynucleotide construct comprising an R gene nucleotide sequence of the invention including, for example, an Sr22 or Sr45 nucleotide sequence or variant thereof. Such a plant that already comprises one or more other R gene nucleotide sequences can comprise R genes that are native to the genome or the plant, that were introduced into the plant via sexual reproduction, or that were introduced by transforming the plant or a progenitor thereof with an R gene nucleotide sequence. Alternatively, the one or more other R gene nucleotide sequences can be introduced into a transgenic plant of the invention, which already comprises a polynucleotide construct of the invention, by, for example, transformation or sexual reproduction.

In other embodiments, two or more different R gene sequences can be introduced into a plant by stably transforming the plant with a polynucleotide construct or vector comprising two or more R gene nucleotide sequences. It is recognized that such an approach can be preferred for plant breeding as it is expected that the two or more R gene nucleotide sequences will be tightly linked and thus, segregate a single locus. Alternatively, a polynucleotide construct of the present invention can be incorporated into the genome of a plant in the immediate vicinity of another R gene nucleotide sequence using homologous recombination-based genome modification methods that are described elsewhere herein or otherwise known in the art.

The present invention further provides methods for enhancing the resistance of a wheat plant to wheat stem rust. The methods comprise introducing a polynucleotide construct of the invention into at least one wheat plant cell. In certain embodiments, the polynucleotide construct is stably incorporated into the genome of wheat plant cell. If desired, the methods can further comprise regenerating the plant cell into a wheat plant comprising in its genome the polynucleotide construct. Preferably, such a regenerated wheat plant comprises enhanced resistance to wheat stem rust caused by at least one race of *Puccinia graminis* f sp. *tritici*, relative to the resistance of a control wheat plant to wheat stem rust caused by the at least one race of *Puccinia graminis* f sp. *tritici*. If desired, the method can further comprise producing a wheat plant, as described above, comprising one, two, three, four, five, six, or more nucleotide sequences encoding an R protein, preferably each nucleotide sequence encoding a different R protein.

The wheat plants disclosed herein find use in methods for limiting wheat stem rust in agricultural crop production, particularly in regions where wheat stem rust is prevalent. The methods of the invention comprise planting a wheat seed produced by a wheat plant of the present invention, wherein the wheat seed comprises at least one R gene nucleotide sequence of the present invention. The methods further comprise growing a wheat plant under conditions favorable for the growth and development of the wheat plant therefrom, and optionally harvesting at least one seed from the wheat plant.

The present invention additionally provides methods for identifying a wheat plant that displays newly conferred or enhanced resistance to wheat stem rust. The methods find use in breeding wheat plants for resistance to wheat stem rust. Such resistant wheat plant find use in the agricultural production of wheat seeds. The methods comprise detecting in a wheat plant the presence of at least one R gene selected from the group consisting of Sr22 and Sr45. In some embodiments of the invention, detecting the presence of the R gene comprises detecting the entire R gene in genomic DNA isolated from the wheat plant. In preferred embodiments, however, detecting the presence of an R gene comprises detecting the presence of at least one marker within the R gene. In other embodiments of the invention, detecting the presence of an R gene comprises detecting the presence of the R protein encoded by the R gene using, for example, immunological detection methods involving antibodies specific to the R protein.

In the methods for identifying a wheat plant that displays newly conferred or enhanced resistance to wheat stem rust, detecting the presence of the R gene in wheat can involve one or more to the following molecular biology techniques that are disclosed elsewhere herein or otherwise known in the art including, but not limited to, isolating genomic DNA and/or RNA from the wheat plant, amplifying nucleic acid molecules comprising the R gene and/or marker therein by PCR amplification, sequencing nucleic acid molecules comprising the R gene and/or marker, identifying the R gene, the marker, or a transcript of the R gene by nucleic acid hybridization, and conducting an immunological assay for the detection of the R protein encoded by the R gene. It is recognized that oligonucleotide probes and PCR primers can be designed to identity the R genes of the present invention and that such probes and PCR primers can be utilized in methods disclosed elsewhere herein or otherwise known in the art to rapidly identify in a population of wheat plants one or more wheat plants comprising the presence of an R gene of the present invention.

Depending on the desired outcome, the polynucleotide constructs of the invention can be stably incorporated into the genome of the plant cell or not stably incorporated into genome of the plant cell. If, for example, the desired outcome is to produce a stably transformed plant with enhanced resistance to wheat stem rust caused by at least one race of *Puccinia graminis* f sp. *tritici*, then the polynucleotide construct can be, for example, fused into a plant transformation vector suitable for the stable incorporation of the polynucleotide construct into the genome of the plant cell. Typically, the stably transformed plant cell will be regenerated into a transformed plant that comprises in its genome the polynucleotide construct. Such a stably transformed plant is capable of transmitting the polynucleotide construct to progeny plants in subsequent generations via sexual and/or asexual reproduction. Plant transformation vectors, methods for stably transforming plants with an introduced polynucleotide construct and methods for plant regeneration from transformed plant cells and tissues are generally known in the art for both monocotyledonous and dicotyledonous plants or described elsewhere herein.

The present invention provides nucleotide acid molecules comprising R genes. Preferably, such R genes are capable of conferring upon a host plant, particularly a wheat plant, enhanced resistance to at least one race of the pathogen that causes wheat stem rust, *Puccinia graminis* f sp. *tritici*. Thus, such R genes find use in limiting wheat stem rust caused by *Puccinia graminis* f. sp. *tritici* in agricultural production. The R genes of the present invention include, but are not limited to, the R genes whose nucleotide sequences are disclosed herein but also include orthologs and other variants that are capable of conferring to a wheat plant resistance to wheat stem rust caused by at least one race of *Puccinia graminis* f sp. *tritici*. Methods are known in the art or otherwise disclosed herein for determining resistance of a plant to stem rust caused by at least one race of *Puccinia graminis* f sp. *tritici*.

The methods of the present invention find use in producing wheat plants with enhanced resistance to stem rust caused by at least one race of *Puccinia graminis* f sp. *tritici*. Typically, the methods of the present invention will enhance or increase the resistance of the subject wheat plant to the least one race of *Puccinia graminis* f. sp. *tritici* by at least 25%, 50%, 75%, 100%, 150%, 200%, 250%, 500% or more when compared to the resistance of a control wheat plant to same race or races of *Puccinia graminis* f. sp. *tritici*. Unless stated otherwise or apparent from the context of a use, a control plant for the present invention is a plant that does not comprise the polynucleotide construct of the present invention. Preferably, the control plant is essentially identical (e.g. same species, subspecies, and variety) to the plant comprising the polynucleotide construction of the present invention accept the control does not comprise the polynucleotide construct. In some embodiments, the control will comprise a polynucleotide construct but not comprise the one or more R gene sequences that are in a polynucleotide construction of the present invention.

Additionally, the present invention provides transformed plants, seeds, and plant cells produced by the methods of present invention and/or comprising a polynucleotide construct of the present invention. Also provided are progeny plants and seeds thereof comprising a polynucleotide construct of the present invention. The present invention also provides seeds, vegetative parts, and other plant parts produced by the transformed plants and/or progeny plants of the invention as well as food products and other agricultural products produced from such plant parts that are intended to be consumed or used by humans and other animals including, but not limited to pets (e.g., dogs and cats) and livestock (e.g., pigs, cows, chickens, turkeys, and ducks).

Non-limiting examples of the compositions and methods of the present invention are as follows:

1. A nucleic acid molecule comprising a nucleotide sequence selected from the group consisting of:

(a) the nucleotide sequence set forth in SEQ ID NO: 1, 4, 7, 10, 19, 22, 25, 34, or 49;

(b) a nucleotide sequence encoding the amino acid sequence set forth in SEQ ID NO: 2, 5, 8, 11, 20, 23, 26, 35, or 50, and optionally, wherein the nucleotide sequence is not naturally occurring;

(c) the nucleotide sequence set forth in SEQ ID NO: 3, 6, 9, 12, 21, 24, 27, 36, or 51;

(d) a nucleotide sequence having at least 85% sequence identity to at least one of the nucleotide sequences set forth in (a) or (c), wherein the nucleic acid molecule is capable of conferring resistance to stem rust to a wheat plant comprising the nucleic acid molecule and optionally, wherein the nucleotide sequence is not naturally occurring; and (e) a nucleic acid molecule comprising a nucleotide sequence encoding an amino acid sequence having at least 85% sequence identity to at least one amino acid sequence set forth in (c), wherein the nucleic acid molecule is capable of conferring resistance to stem rust to a wheat plant comprising the nucleic acid molecule and optionally, wherein the nucleotide sequence is not naturally occurring.

2. The nucleic acid molecule of claim 1, wherein the nucleic acid molecule is an isolated nucleic acid molecule.

3. The nucleic acid molecule of claim 1 or 2, wherein the nucleic acid molecule of (d) or (e) encodes a protein comprising a coiled-coil domain, a nucleotide-binding domain, and a leucine-rich repeat domain.

4. The nucleic acid molecule of claim 3, wherein at least one of the coiled-coil domain, the nucleotide-binding domain, and the leucine-rich repeat domain comprises an amino acid sequence having at least 95%, 96%, 97%, 98%, 99%, or 100% to the corresponding domain in SEQ ID NO: 2 or 50.

5. The nucleic acid molecule of claim 3 or 4, wherein the leucine-rich repeat domain comprises an amino acid selected from the group consisting of serine (S) at the amino acid position corresponding to amino acid 607 of SEQ ID NO: 2, tyrosine (Y) at the amino acid position corresponding to amino acid 650, of SEQ ID NO: 2, serine (S) at the amino acid position corresponding to amino acid 651 of SEQ ID NO: 2, and glycine (G) at the amino acid position corresponding to amino acid 657 of SEQ ID NO: 2.

6. An expression cassette comprising the nucleic acid molecule of any one of claims 1-5 and an operably linked heterologous promoter.

7. A vector comprising the nucleic acid molecule of any one of claims 1-5 or the expression cassette of claim 6.

8. A vector of claim 7, further comprising an additional wheat stem rust resistance gene.

9. The vector of claim 8, wherein the additional wheat stem rust resistance gene is selected from the group consisting of Sr26, Sr32, Sr33, Sr39, Sr40, Sr47, and Sr50.

10. A host cell transformed with the nucleic acid molecule of claim any one of claims 1-5, the expression cassette of claim 6, or the vector of any one of claims 7-9.

11. The host cell of claim 10, wherein the host cell is a plant cell, a bacterium, a fungal cell, or an animal cell.

12. The host cell of claim 10 or 11, wherein the host cell is not *Triticum boeoticum* or *Triticum monococcum*.

13. A plant transformed with the nucleic acid molecule of any one of claims 1-5, the expression cassette of claim 6, or the vector of any one of claims 7-9.

14. The plant of claim 13, wherein the plant is a wheat plant.

15. The plant of claim 14, wherein the wheat plant is not *Triticum boeoticum* or *Triticum monococcum*.

16. A transgenic plant or seed comprising stably incorporated in its genome a polynucleotide construct comprising a nucleotide sequence selected from the group consisting of:

(a) the nucleotide sequence set forth in SEQ ID NO: 1, 4, 7, 10, 19, 22, 25, 34, or 49;

(b) a nucleotide sequence encoding the amino acid sequence set forth in SEQ ID NO: 2, 5, 8, 11, 20, 23, 26, 35, or 50, and optionally, wherein the nucleotide sequence is not naturally occurring;

(c) the nucleotide sequence set forth in SEQ ID NO: 3, 6, 9, 12, 21, 24, 27, 36, or 51;

(d) a nucleotide sequence having at least 85% sequence identity to at least one of the nucleotide sequences set forth in (a) or (c), wherein the nucleic acid molecule is capable of conferring resistance to stem rust to a wheat plant comprising the nucleic acid molecule and optionally, wherein the nucleotide sequence is not naturally occurring; and (e) a nucleic acid molecule comprising a nucleotide sequence encoding an amino acid sequence having at least 85% sequence identity to at least one amino acid sequence set forth in (c), wherein the nucleic acid molecule is capable of conferring resistance to stem rust to a wheat plant comprising the nucleic acid molecule and optionally, wherein the nucleotide sequence is not naturally occurring.

17. The transgenic plant or seed of claim 16, wherein the nucleic acid molecule of (d) or (e) encodes a protein comprising a coiled-coil domain, a nucleotide-binding domain, and a leucine-rich repeat domain.

18. The transgenic plant or seed of claim 17, wherein at least one of the coiled-coil domain, the nucleotide-binding domain, and the leucine-rich repeat domain comprises an amino acid sequence having at least 95%, 96%, 97%, 98%, 99%, or 100% to the corresponding domain in SEQ ID NO: 2 or 50.

19. The transgenic plant or seed of claim 17 or 18, wherein the leucine-rich repeat domain comprises an amino acid selected from the group consisting of serine (S) at the amino acid position corresponding to amino acid 607 of SEQ ID NO: 2, tyrosine (Y) at the amino acid position corresponding to amino acid 650, of SEQ ID NO: 2, serine (S) at the amino acid position corresponding to amino acid 651 of SEQ ID NO: 2, and glycine (G) at the amino acid position corresponding to amino acid 657 of SEQ ID NO: 2.

20. The transgenic plant or seed of any one of claims 16-19, wherein the polynucleotide construct comprises the nucleotide sequence of any one of (b)-(e) and further comprises a promoter operably linked for the expression of the nucleotide sequence in a plant.

21. The transgenic plant or seed of claim 20, wherein the promoter is selected from the group consisting of pathogen-inducible, constitutive, tissue-preferred, wound-inducible, and chemical-regulated promoters.

22. The transgenic plant or seed of claim any one of claims 16-21, wherein the transgenic plant is a wheat plant and the transgenic seed is wheat seed.

23. The transgenic plant or seed of claim 22, wherein the transgenic plant or seed comprises enhanced resistance to wheat stem rust caused by at least one race of *Puccinia graminis* f sp. *tritici*, relative to a control wheat plant.

24. The transgenic plant or seed of claim 22 or 23, wherein the polynucleotide construct comprises at least two nucleotide sequences encoding an R protein for wheat stem rust.

25. The transgenic plant or seed of claim 24, wherein each of the at least two nucleotide sequences encoding an R protein for wheat stem rust encodes a different R protein for wheat stem rust.

26. A method for enhancing the resistance of a wheat plant to wheat stem rust, the method comprising introducing a polynucleotide construct into at least one wheat plant cell, the polynucleotide construct comprising a nucleotide sequence selected from the group consisting of:

(a) the nucleotide sequence set forth in SEQ ID NO: 1, 4, 7, 10, 19, 22, 25, 34, or 49;

(b) a nucleotide sequence encoding the amino acid sequence set forth in SEQ ID NO: 2, 5, 8, 11, 20, 23, 26, 35, or 50, and optionally, wherein the nucleotide sequence is not naturally occurring;

(c) the nucleotide sequence set forth in SEQ ID NO: 3, 6, 9, 12, 21, 24, 27, 36, or 51;

(d) a nucleotide sequence having at least 85% sequence identity to at least one of the nucleotide sequences set forth in (a) or (c), wherein the nucleic acid molecule is capable of conferring resistance to stem rust to a wheat plant comprising the nucleic acid molecule and optionally, wherein the nucleotide sequence is not naturally occurring; and (e) a nucleic acid molecule comprising a nucleotide sequence encoding an amino acid sequence having at least 85% sequence identity to at least one amino acid sequence set forth in (c), wherein the nucleic acid molecule is capable of conferring resistance to stem rust to a wheat plant comprising the nucleic acid molecule and optionally, wherein the nucleotide sequence is not naturally occurring.

27. The method of claim 26, wherein the nucleic acid molecule of (d) or (e) encodes a protein comprising a coiled-coil domain, a nucleotide-binding domain, and a leucine-rich repeat domain.

28. The method of claim 27, wherein at least one of the coiled-coil domain, the nucleotide-binding domain, and the leucine-rich repeat domain comprises an amino acid sequence having at least 95%, 96%, 97%, 98%, 99%, or 100% to the corresponding domain in SEQ ID NO: 2 or 50.

29. The method of claim 27 or 28, wherein the leucine-rich repeat domain comprises an amino acid selected from the group consisting of serine (S) at the amino acid position corresponding to amino acid 607 of SEQ ID NO: 2, tyrosine (Y) at the amino acid position corresponding to amino acid 650, of SEQ ID NO: 2, serine (S) at the amino acid position corresponding to amino acid 651 of SEQ ID NO: 2, and glycine (G) at the amino acid position corresponding to amino acid 657 of SEQ ID NO: 2.

30. The method of any one of claims 26-29, wherein the polynucleotide construct is stably incorporated into the genome of the plant cell.

31. The method of any one of claims 26-30, wherein the wheat plant cell is regenerated into a wheat plant comprising in its genome the polynucleotide construct.

32. The method of any one of claims 26-31, wherein the polynucleotide construct comprises the nucleotide sequence of any one of (b)-(e) and further comprises a promoter operably linked for the expression of the nucleotide sequence in a plant.

33. The method of claim 32, wherein the promoter is selected from the group consisting of pathogen-inducible, constitutive, tissue-preferred, wound-inducible, and chemical-regulated promoters.

34. The method of any one of claims 26-33, wherein the wheat plant comprising the polynucleotide construct comprises enhanced resistance to wheat stem rust caused by at least one race of *Puccinia graminis* f sp. *tritici*, relative to a control wheat plant.

35. The method of any one of claims 26-34, wherein the polynucleotide construct comprises at least two nucleotide sequences encoding an R protein for wheat stem rust.

36. The method of claim 35, wherein each of the at least two nucleotide sequences encoding an R protein for wheat stem rust encodes a different R protein for wheat stem rust.

37. A wheat plant produced by the method of any one of claims 26-36.

38. A seed of the wheat plant of claim 37, wherein the seed comprises the polynucleotide construct.

39. A method of limiting wheat stem rust in agricultural crop production, the method comprising planting a wheat seed according to any one of claims 22-25 and 38 and growing a wheat plant under conditions favorable for the growth and development of the wheat plant.

40. The method of claim 39, further comprising harvesting an at least one seed from the wheat plant.

41. Use of the wheat plant or seed of any one of claims 22-25, 37, and 38 in agriculture.

42. A human or animal food product produced using the wheat plant or seed of any one of claims 22-25, 37, and 38.

43. A polypeptide comprising an amino acid sequence selected from the group consisting of:

(a) the amino acid sequence encoded by the nucleotide sequence set forth in SEQ ID NO: 1, 4, 7, 10, 19, 22, 25, 34, or 49;

(b) the amino acid sequence set forth in SEQ ID NO: 2, 5, 8, 11, 20, 23, 26, 35, or 50;

(c) the amino acid sequence encoded by the nucleotide sequence set forth in SEQ ID NO: 3; and (d) an amino acid sequence having at least 85% sequence identity to at least one amino acid sequence set forth in (c), wherein a polypeptide comprising the amino acid sequence is capable of conferring resistance to stem rust to a wheat plant comprising the polypeptide, and optionally, and wherein the polypeptide is not naturally occurring.

44. The polypeptide of claim 43, wherein the polypeptide of (d) comprises a coiled-coil domain, a nucleotide-binding domain, and a leucine-rich repeat domain.

45. The polypeptide of claim 44, wherein at least one of the coiled-coil domain, the nucleotide-binding domain, and the leucine-rich repeat domain comprises an amino acid sequence having at least 95%, 96%, 97%, 98%, 99%, or 100% to the corresponding domain in SEQ ID NO: 2 or 50.

46. The polypeptide of claim 44 or 45, wherein the leucine-rich repeat domain comprises an amino acid selected from the group consisting of serine (S) at the amino acid position corresponding to amino acid 607 of SEQ ID NO: 2, tyrosine (Y) at the amino acid position corresponding to amino acid 650, of SEQ ID NO: 2, serine (S) at the amino acid position corresponding to amino acid 651 of SEQ ID NO: 2, and glycine (G) at the amino acid position corresponding to amino acid 657 of SEQ ID NO: 2.

47. A method for identifying a wheat plant that displays newly conferred or enhanced resistance to wheat stem rust, the method comprising detecting in the wheat plant the presence of an R gene selected from the group consisting of Sr22 and Sr45.

48. The method of claim 47, wherein the presence of the R gene is detected by detecting at least one marker within the R gene.

49. The method of claim 47 or 48, wherein the method comprises detecting the presence of both Sr22 and Sr45.

50. The method of any one of claims 47-49, wherein Sr22 comprises or consists of the nucleotide sequence set forth in SEQ ID NO: 1, 4, 7, 10, 19, 22, 25, or 34 and Sr45 comprises or consists of the nucleotide sequence set forth in SEQ ID NO: 49.

51. The method of any one of claims 47-50, wherein detecting the presence of the R gene comprises a member selected from the group consisting of PCR amplification, nucleic acid sequencing, nucleic acid hybridization, and an immunological assay for the detection of the R protein encoded by the R gene.

52. A wheat plant identified by the process of any one of claims 47-51.

53. A seed of the wheat plant of claim 52.

Additional embodiments of the methods and compositions of the present invention are described elsewhere herein.

The methods of the invention can be used to enhance the resistance of a wheat plant to wheat stem rust, particularly stem rust caused by at least one race of *Puccinia graminis* f. sp. *tritici*. Preferred plants of the invention are wheat plants, wheat seeds, wheat plant parts, and wheat plant cells. As used herein, the term "wheat plant" generally refers to a plant that is a member of the *Triticum* genus or a member of another genus within the Triticeae tribe, particularly a member of another genus that is capable of producing interspecific hybrids with at least one *Triticum* sp. Examples of such another genus within the Triticeae tribe are *Aegilops* and *Secale*.

The wheat plants of the present invention include, for example, domesticated and non-domesticated plants. The wheat plants of the present invention include, but are not limited to, the following *Triticum*, *Aegilops* and *Secale* species: *T. aestivum, T. monococcum, T. turgidum, T. boeoticum, T. timopheevii*, and *T. urartu, A. tauschii, S. cereale*, and hybrids thereof. Examples of *T. aestivum* subspecies included within the present invention are *aestivum* (common wheat), *compactum* (club wheat), *macha* (macha wheat), *vavilovi* (vavilovi wheat), *spelta*, and sphaerococcum (shot wheat). Examples of *T. turgidum* subspecies included within the present invention are *turgidum, carthlicum*, dicoccom, *durum*, paleocoichicum, *polonicum, turanicum*, and *dicoccoides*. Examples of *T. monococcum* subspecies included within the present invention are *monococcum* (einkorn) and aegilopoides. In one embodiment of the present invention, the wheat plant is a member of the *Triticum turgidum* species; and in particular, a member of the Durum subspecies, for example, a Ciccio, Colosseo, or Utopia cultivar. It is recognized that a wheat plant of the present invention can be a domesticated and a non-domesticated wheat plant.

The present invention also encompasses triticale plants, triticale plant parts, and tritcale plant cells comprising an R gene of the invention. As used herein, a "triticale plant" refers to a plant that is created by crossing a rye plant (*Secale cereale*) with either a tetraploid wheat plant (e.g. *Triticum turgidum*) or a hexaploid wheat plant (e.g. *Triticum aestivum*). The present invention also includes seeds produced by the triticale plants described herein and methods for controlling weeds in the vicinity of the triticale plants described herein. As used herein, the term "wheat plant" encompasses triticale plants unless stated otherwise or apparent from the context of use.

The term "wheat plant" is intended to encompass wheat plants at any stage of maturity or development, as well as any tissues or organs (plant parts) taken or derived from any such plant unless otherwise clearly indicated by context. Plant parts include, but are not limited to, stems, roots, flowers, ovules, stamens, leaves, embryos, meristematic regions, callus tissue, anther cultures, gametophytes, sporophytes, pollen, microspores, protoplasts, and the like. The present invention also includes seeds produced by the wheat plants of the present invention.

In one embodiment of the invention, the nucleotide sequences encoding R proteins have at least about 80%, 85%, 90%, 91%, 92%, 93%, 94%, 95%, 96%, 97%, 98%, 99% or more sequence identity to the entire nucleotide sequence set forth in SEQ ID NO: 1 or to a fragment thereof. In another embodiment of the invention, the nucleotide sequences encoding R proteins have at least about 80%, 85%, 90%, 91%, 92%, 93%, 94%, 95%, 96%, 97%, 98%, 99% or more sequence identity to the entire nucleotide sequence set forth in SEQ ID NO: 3 or to a fragment thereof.

The present invention encompasses isolated or substantially purified polynucleotide (also referred to herein as "nucleic acid molecule", "nucleic acid" and the like) or protein (also referred to herein as "polypeptide") compositions including, for example, polynucleotides and proteins comprising the sequences set forth in the accompanying Sequence Listing as well as variants and fragments of such polynucleotides and proteins. An "isolated" or "purified" polynucleotide or protein, or biologically active portion thereof, is substantially or essentially free from components that normally accompany or interact with the polynucleotide or protein as found in its naturally occurring environment. Thus, an isolated or purified polynucleotide or protein is substantially free of other cellular material or culture medium when produced by recombinant techniques, or substantially free of chemical precursors or other chemicals when chemically synthesized. Optimally, an "isolated" polynucleotide is free of sequences (optimally protein encoding sequences) that naturally flank the polynucleotide (i.e., sequences located at the 5' and 3' ends of the polynucleotide) in the genomic DNA of the organism from which the polynucleotide is derived. For example, in various embodiments, the isolated polynucleotide can contain less than about 5 kb, 4 kb, 3 kb, 2 kb, 1 kb, 0.5 kb, or 0.1 kb of nucleotide sequence that naturally flank the polynucleotide in genomic DNA of the cell from which the polynucleotide is derived. A protein that is substantially free of cellular material includes preparations of protein having less than about 30%, 20%, 10%, 5%, or 1% (by dry weight) of contaminating protein. When the protein of the invention or biologically active portion thereof is recombinantly produced, optimally culture medium represents less than about 30%, 20%, 10%, 5%, or 1% (by dry weight) of chemical precursors or non-protein-of-interest chemicals.

Fragments and variants of the disclosed polynucleotides and proteins encoded thereby are also encompassed by the present invention. By "fragment" is intended a portion of the polynucleotide or a portion of the amino acid sequence and hence protein encoded thereby. Fragments of polynucleotides comprising coding sequences may encode protein fragments that retain biological activity of the full-length or native protein. Alternatively, fragments of a polynucleotide that are useful as hybridization probes generally do not encode proteins that retain biological activity or do not retain promoter activity. Thus, fragments of a nucleotide sequence may range from at least about 20 nucleotides, about 50 nucleotides, about 100 nucleotides, and up to the full-length polynucleotide of the invention.

Polynucleotides that are fragments of a native R polynucleotide comprise at least 16, 20, 50, 75, 100, 125, 150, 175, 200, 300, 400, 500, 1000, 2000, 5000, 7500, or 9500 contiguous nucleotides, or up to the number of nucleotides present in a full-length R polynucleotide disclosed herein (for example, 9859 nucleotides for of SEQ ID NO: 1).

"Variants" is intended to mean substantially similar sequences. For polynucleotides, a variant comprises a polynucleotide having deletions (i.e., truncations) at the 5' and/or 3' end; deletion and/or addition of one or more nucleotides at one or more internal sites in the native polynucleotide; and/or substitution of one or more nucleotides at one or more sites in the native polynucleotide. As used herein, a "native" polynucleotide or polypeptide comprises a naturally occurring nucleotide sequence or amino acid sequence, respectively. For polynucleotides, conservative variants include those sequences that, because of the degeneracy of the genetic code, encode the amino acid sequence of one of the R proteins of the invention. Naturally occurring allelic variants such as these can be identified with the use of well-known molecular biology techniques, as, for example, with polymerase chain reaction (PCR) and hybridization techniques as outlined below. Variant polynucleotides also include synthetically derived polynucleotides, such as those generated, for example, by using site-directed mutagenesis but which still encode an R protein of the invention. Generally, variants of a particular polynucleotide of the invention will have at least about 80%, 85%, 90%, 91%, 92%, 93%, 94%, 95%, 96%, 97%, 98%, 99% or more sequence identity to that particular polynucleotide as determined by sequence alignment programs and parameters as described elsewhere herein. In certain embodiments of the invention, variants of a particular polynucleotide of the invention will have at least about 80%, 85%, 90%, 91%, 92%, 93%, 94%, 95%, 96%, 97%, 98%, 99% or more sequence identity to at least one nucleotide sequence selected from the group consisting of SEQ ID NOS: 1, 3, 4, 6, 7, 9, 10, 12, 19, 21, 22, 24, 25, 27, 34, 36, 49, and 51, and optionally comprises a non-naturally occurring nucleotide sequence that differs from the nucleotide sequence set forth in SEQ ID NO: 1, 3, 4, 6, 7, 9, 10, 12, 19, 21, 22, 24, 25, 27, 34, 36, 49, and/or 51 by at least one nucleotide modification selected from the group consisting of the substitution of at least one nucleotide, the addition of at least one nucleotide, and the deletion of at least one nucleotide.

Variants of a particular polynucleotide of the invention (i.e., the reference polynucleotide) can also be evaluated by comparison of the percent sequence identity between the polypeptide encoded by a variant polynucleotide and the polypeptide encoded by the reference polynucleotide. Thus, for example, a polynucleotide that encodes a polypeptide with a given percent sequence identity to the polypeptide of at least one of SEQ ID NOS: 2, 5, 8, 11, 20, 23, 26, 35, and 50 is disclosed. Percent sequence identity between any two polypeptides can be calculated using sequence alignment programs and parameters described elsewhere herein. Where any given pair of polynucleotides of the invention is evaluated by comparison of the percent sequence identity shared by the two polypeptides they encode, the percent sequence identity between the two encoded polypeptides is at least about 60%, 65%, 70%, 75%, 80%, 85%, 86%, 87%, 88%, 89%, 90%, 91%, 92%, 93%, 94%, 95%, 96%, 97%, 98%, 99% or more sequence identity. In certain embodiments of the invention, variants of a particular polypeptide of the invention will have at least about 80%, 85%, 90%, 91%, 92%, 93%, 94%, 95%, 96%, 97%, 98%, 99% or more sequence identity to at least one amino acid sequence selected from the group consisting of SEQ ID NOS: 2, 5, 8, 11, 20, 23, 26, 35, and 50, and optionally comprises a non-naturally occurring amino acid sequence that differs from the amino acid set forth in SEQ ID NO: 2, 5, 8, 11, 20, 23, 26, 35, and/or 50 by at least one amino acid modification selected from the group consisting of the substitution of at least one amino acid, the addition of at least one amino acid, and the deletion of at least one amino acid.

"Variant" protein is intended to mean a protein derived from the native protein by deletion (so-called truncation) of one or more amino acids at the N-terminal and/or C-terminal end of the native protein; deletion and/or addition of one or more amino acids at one or more internal sites in the native protein; or substitution of one or more amino acids at one or more sites in the native protein. Such variants may result from, for example, genetic polymorphism or from human manipulation. Biologically active variants of an R protein will have at least about 80%, 85%, 86%, 87%, 88%, 89%, 90%, 91%, 92%, 93%, 94%, 95%, 96%, 97%, 98%, 99% or more sequence identity to the amino acid sequence for the native protein (e.g. the amino acid sequence set forth in SEQ ID NO: 2, 5, 8, 11, 20, 23, 26, 35, and/or 50) as determined by sequence alignment programs and parameters described elsewhere herein. A biologically active variant of a protein of the invention may differ from that protein by as few as 1-15 amino acid residues, as few as 1-10, such as 6-10, as few as 5, as few as 4, 3, 2, or even 1 amino acid residue.

The proteins of the invention may be altered in various ways including amino acid substitutions, deletions, truncations, and insertions. Methods for such manipulations are generally known in the art. Methods for mutagenesis and polynucleotide alterations are well known in the art. See, for example, Kunkel (1985) *Proc. Natl. Acad. Sci. USA* 82:488-492; Kunkel et al. (1987) *Methods in Enzymol.* 154:367-382; U.S. Pat. No. 4,873,192; Walker and Gaastra, eds. (1983) *Techniques in Molecular Biology* (MacMillan Publishing Company, New York) and the references cited therein. Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference. Conservative substitutions, such as exchanging one amino acid with another having similar properties, may be optimal.

Thus, the genes and polynucleotides of the invention include both the naturally occurring sequences as well as mutant and other variant forms. Likewise, the proteins of the invention encompass both naturally occurring proteins as well as variations and modified forms thereof, More preferably, such variants confer to a plant or part thereof comprising the variant enhanced resistance wheat stem rust caused by at least one race of *Puccinia graminis* f. sp. *tritici*. In some embodiments, the mutations that will be made in the DNA encoding the variant will not place the sequence out of reading frame. Optimally, the mutations will not create complementary regions that could produce secondary mRNA structure. See, EP Patent Application Publication No. 75,444.

The deletions, insertions, and substitutions of the protein sequences encompassed herein are not expected to produce radical changes in the characteristics of the protein. However, when it is difficult to predict the exact effect of the substitution, deletion, or insertion in advance of doing so, one skilled in the art will appreciate that the effect will be evaluated by routine screening assays. That is, the activity can be evaluated by assays that are disclosed herein below.

For example, a wheat plant that is susceptible to wheat stem rust caused by a particular race of *Puccinia graminis* f sp. *tritici* can be transformed with an Sr22 or Sr45 polynucleotide, regenerated into a transformed or transgenic plant comprising the polynucleotide, and tested for resistance to wheat stem rust caused by the particular race of *Puccinia graminis* f sp. *tritici* using standard resistance assays known in the art or described elsewhere herein. Preferred variant polynucleotides and polypeptides of the present invention confer or are capable of conferring upon a wheat plant enhanced resistance to at least one race of *Puccinia graminis* f sp. *tritici* that is known to cause wheat stem rust in a susceptible wheat plant.

Variant polynucleotides and proteins also encompass sequences and proteins derived from a mutagenic and recombinogenic procedure such as DNA shuffling. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

The polynucleotides of the invention can be used to isolate corresponding sequences from other organisms, particularly other plants. In this manner, methods such as PCR, hybridization, and the like can be used to identify such sequences based on their sequence homology to the sequences set forth herein. Sequences isolated based on their sequence identity to the entire sequences set forth herein or to variants and fragments thereof are encompassed by the present invention. Such sequences include sequences that are orthologs of the disclosed sequences. "Orthologs" is intended to mean genes derived from a common ancestral gene and which are found in different species as a result of speciation. Genes found in different species are considered orthologs when their nucleotide sequences and/or their encoded protein sequences share at least 60%, 70%, 75%, 80%, 85%, 86%, 87%, 88%, 89%, 90%, 91%, 92%, 93%, 94%, 95%, 96%, 97%, 98%, 99%, or greater sequence identity. Functions of orthologs are often highly conserved among species. Thus, isolated polynucleotides that encode R proteins and which hybridize under stringent conditions to at least one of the R proteins disclosed herein or otherwise known in the art, or to variants or fragments thereof, are encompassed by the present invention.

In one embodiment, the orthologs of the present invention have coding sequences comprising at least 80%, 85%, 86%, 87%, 88%, 89%, 90%, 91%, 92%, 93%, 94%, 95%, 96%, 97%, 98%, 99%, or greater nucleotide sequence identity to a nucleotide sequence selected from the group consisting of the nucleotide sequences set forth in SEQ ID NOS: 1, 3, 4, 6, 7, 9, 10, 12, 19, 21, 22, 24, 25, 27, 34, 36, 49, and 51 and/or encode proteins comprising least 80%, 85%, 86%, 87%, 88%, 89%, 90%, 91%, 92%, 93%, 94%, 95%, 96%, 97%, 98%, 99%, or greater amino acid sequence identity to an amino acid sequence selected from the group consisting of the amino acid sequences set forth in SEQ ID NOS: 2, 5, 8, 11, 20, 23, 26, 35, and 50.

As illustrated in FIGS. 8 and 9, the SR22 and SR45 proteins comprise certain conserved domains. In SR22 from Schomburgk (comprising the amino acid sequence set forth in SEQ ID NO: 2), the conserved domains include, for example, a coiled-coil domain (amino acids 120-147), a nucleotide-binding domain (amino acids 178-465) and a leucine-rich repeat domain (amino acids 601-853). In SR45 (comprising the amino acid sequence set forth in SEQ ID NO: 50), the conserved domains include, for example, a coiled-coil domain (amino acids 32-55), a nucleotide-binding domain (amino acids 175-452) and a leucine-rich repeat domain (amino acids 578-867). Preferably, variant SR22 and SR45 proteins of the present invention comprise a coiled-coil domain, a nucleotide-binding domain, and a leucine-rich repeat domain corresponding to the domains shown in FIGS. 8 and 9, respectively.

In some embodiments, variant SR22 and SR45 proteins of the present invention comprise a higher percentage of amino acid sequence identity to one, two, or three of such conserved domains than to one or more full-length amino acid sequences of the SR22 (e.g. SEQ ID NO: 2, 5, 8, 11, 20, 23, 26, or 35) or SR45 (e.g. SEQ ID NO: 50) proteins disclosed herein. Preferably, such variants comprise a corresponding domain or domains having at least 95%, 96%, 97%, 98%, 99%, or 100% sequence identity to one, two, or three of the conserved domains shown in FIG. 8 and further comprise an amino acid sequence having at least 80%, 85%, 86%, 87%, 88%, 89%, 90%, 91%, 92%, 93%, 94%, 95%, 96%, 97%, 98%, or 99% identity to an amino acid sequence selected from the group consisting of the amino acid sequences set forth in SEQ ID NOS: 2, 5, 8, 11, 20, 23, 26, 35, and 50.

In some embodiments, variant SR22 proteins of the present invention comprise at least one of the following amino acids of the amino acid sequence of SEQ ID NO: 2 which are conserved in the leucine-rich repeat domain of the SR22 proteins comprising the amino acid sequences set forth in SEQ ID NOS: 2, 5, 8, 11, 20, 23, 26, and 35: serine (S) at amino acid position 607, tyrosine (Y) at amino acid position 650, serine (S) at amino acid position 651, and glycine (G) at amino acid position 657. In preferred embodiments, the variant SR22 proteins comprise one, two, three, or four of these conserved amino acids and optionally comprise an amino acid sequence having at least 80%, 85%, 86%, 87%, 88%, 89%, 90%, 91%, 92%, 93%, 94%, 95%, 96%, 97%, 98%, or 99% identity to an amino acid sequence selected from the group consisting of the amino acid sequences set forth in SEQ ID NOS: 2, 5, 8, 11, 20, 23, 26, 35, and 50, and alternatively comprise, or optionally further comprise, a corresponding domain or domains having at least 95%, 96%, 97%, 98%, 99%, or 100% sequence identity to one, two, or three of the conserved domains, respectively, shown in FIG. 8.

It is recognized that domains in variant SR22 and SR45 proteins corresponding to those conserved domains shown in FIGS. 8 and 9, as well as any particular conserved amino acids therein, can be identified by methods known to those of skill in the art or disclosed elsewhere herein such as, for example, multiple sequence alignment. It is further recognized that the positions of such conserved domains and conserved amino acids within a particular variant SR22 and SR45 can vary from the positions in the amino acid sequences set forth in SEQ ID NOS: 2 and 50 and that through methods such as, for example, multiple sequence alignment, the corresponding positions of such conserved domains and conserved amino acids can be determined for any variant SR22 or SR45 protein of the present invention.

Preferably, the variant SR22 and SR45 proteins of the present invention and the polynucleotides encoding them confer, or are capable of conferring upon a wheat plant comprising such a protein or polynucleotide, enhanced resistance to at least one race of *Puccinia graminis* f sp. *tritici* that is known to cause wheat stem rust in a susceptible wheat plant.

In a PCR approach, oligonucleotide primers can be designed for use in PCR reactions to amplify corresponding DNA sequences from cDNA or genomic DNA extracted from any plant of interest. Methods for designing PCR primers and PCR cloning are generally known in the art and are disclosed in Sambrook et al. (1989) *Molecular Cloning: A Laboratory Manual* (2d ed., Cold Spring Harbor Laboratory Press, Plainview, N.Y.). See also Innis et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

In hybridization techniques, all or part of a known polynucleotide is used as a probe that selectively hybridizes to other corresponding polynucleotides present in a population of cloned genomic DNA fragments or cDNA fragments (i.e., genomic or cDNA libraries) from a chosen organism. The hybridization probes may be genomic DNA fragments, cDNA fragments, RNA fragments, or other oligonucleotides, and may be labeled with a detectable group such as $^{32}$P, or any other detectable marker. Thus, for example, probes for hybridization can be made by labeling synthetic oligonucleotides based on the polynucleotides of the invention. Methods for preparation of probes for hybridization and for construction of cDNA and genomic libraries are generally known in the art and are disclosed in Sambrook et al. (1989) *Molecular Cloning: A Laboratory Manual* (2d ed., Cold Spring Harbor Laboratory Press, Plainview, N.Y.).

For example, an entire polynucleotide disclosed herein, or one or more portions thereof, may be used as a probe capable of specifically hybridizing to corresponding polynucleotide and messenger RNAs. To achieve specific hybridization under a variety of conditions, such probes include sequences that are unique among the sequence of the gene or cDNA of interest sequences and are optimally at least about 10 nucleotides in length, and most optimally at least about 20 nucleotides in length. Such probes may be used to amplify corresponding polynucleotides for the particular gene of interest from a chosen plant by PCR. This technique may be used to isolate additional coding sequences from a desired plant or as a diagnostic assay to determine the presence of coding sequences in a plant. Hybridization techniques include hybridization screening of plated DNA libraries (either plaques or colonies; see, for example, Sambrook et al. (1989) *Molecular Cloning: A Laboratory Manual* (2d ed., Cold Spring Harbor Laboratory Press, Plainview, N.Y.).

Hybridization of such sequences may be carried out under stringent conditions. By "stringent conditions" or "stringent hybridization conditions" is intended conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, optimally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

Specificity is typically the function of post-hybridization washes, the critical factors being the ionic strength and temperature of the final wash solution. For DNA-DNA hybrids, the $T_m$ can be approximated from the equation of Meinkoth and Wahl (1984) *Anal. Biochem.* 138:267-284: $T_m=81.5°$ C.$+16.6$ (log M)$+0.41$ (% GC)$-0.61$ (% form)$-500/L$; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization, and/or wash conditions can be adjusted to hybridize to sequences of the desired identity. For example, if sequences with ≥90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution), it is optimal to increase the SSC concentration so that a higher temperature can be used. An extensive guide to the hybridization of nucleic acids is found in Tijssen (1993) *Laboratory Techniques in Biochemistry and Molecular Biology—Hybridization with Nucleic Acid Probes*, Part I, Chapter 2 (Elsevier, New York); and Ausubel et al., eds. (1995) *Current Protocols in Molecular Biology*, Chapter 2 (Greene Publishing and Wiley-Interscience, New York). See Sambrook et al. (1989) *Molecular Cloning: A Laboratory Manual* (2d ed., Cold Spring Harbor Laboratory Press, Plainview, N.Y.).

It is recognized that the R protein coding sequences of the present invention encompass polynucleotide molecules comprising a nucleotide sequence that is sufficiently identical to the nucleotide sequence of any one or more of SEQ ID NOS: 1, 3, 4, 6, 7, 9, 10, 12, 19, 21, 22, 24, 25, 27, 36, 37, 39, 40, 42, 49, and 51. The term "sufficiently identical" is used herein to refer to a first amino acid or nucleotide sequence that contains a sufficient or minimum number of identical or equivalent (e.g., with a similar side chain) amino acid residues or nucleotides to a second amino acid or nucleotide sequence such that the first and second amino acid or nucleotide sequences have a common structural domain and/or common functional activity. For example, amino acid or nucleotide sequences that contain a common structural domain having at least about 45%, 55%, or 65% identity, preferably 75% identity, more preferably 85%, 86%, 87%, 88%, 89%, 90%, 95%, 96%, 97%, 98% or 99% identity are defined herein as sufficiently identical.

To determine the percent identity of two amino acid sequences or of two nucleic acids, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are the same length. The percent identity between two sequences can be determined using techniques similar to those described below, with or without allowing gaps. In calculating percent identity, typically exact matches are counted.

The determination of percent identity between two sequences can be accomplished using a mathematical algorithm. A preferred, nonlimiting example of a mathematical algorithm utilized for the comparison of two sequences is the algorithm of Karlin and Altschul (1990) *Proc. Natl. Acad. Sci. USA* 87:2264, modified as in Karlin and Altschul (1993) *Proc. Natl. Acad. Sci. USA* 90:5873-5877. Such an algorithm is incorporated into the NBLAST and XBLAST programs of Altschul et al. (1990) *J. Mol. Biol.* 215:403. BLAST nucleotide searches can be performed with the NBLAST program, score=100, wordlength=12, to obtain nucleotide sequences homologous to the polynucleotide molecules of the invention. BLAST protein searches can be performed with the XBLAST program, score=50, wordlength=3, to obtain amino acid sequences homologous to protein molecules of the invention. To obtain gapped alignments for comparison purposes, Gapped BLAST can be utilized as described in Altschul et al. (1997) *Nucleic Acids Res.* 25:3389. Alternatively, PSI-Blast can be used to perform an iterated search that detects distant relationships between molecules. See Altschul et al. (1997) supra. When utilizing BLAST, Gapped BLAST, and PSI-Blast programs, the default parameters of the respective programs (e.g., XBLAST and NBLAST; available on the world-wide web at ncbi.nlm.nih.gov). Another preferred, non-limiting example of a mathematical algorithm utilized for the comparison of sequences is the algorithm of Myers and Miller (1988) *CABIOS* 4:11-17. Such an algorithm is incorporated into the ALIGN program (version 2.0), which is part of the GCG sequence alignment software package. When utilizing the ALIGN program for comparing amino acid sequences, a PAM120 weight residue table, a gap length penalty of 12, and a gap penalty of 4 can be used. Alignment may also be performed manually by inspection.

Unless otherwise stated, sequence identity/similarity values provided herein refer to the value obtained using the full-length sequences of the invention and using multiple alignment by mean of the algorithm Clustal W (Nucleic Acid Research, 22(22):4673-4680, 1994) using the program AlignX included in the software package Vector NTI Suite Version 7 (InforMax, Inc., Bethesda, Md., USA) using the default parameters; or any equivalent program thereof. By "equivalent program" is intended any sequence comparison program that, for any two sequences in question, generates an alignment having identical nucleotide or amino acid residue matches and an identical percent sequence identity when compared to the corresponding alignment generated by CLUSTALW (Version 1.83) using default parameters (available at the European Bioinformatics Institute website on the world-wide web at: ebi.ac.uk/Tools/clustalw/index.html).

The use of the term "polynucleotide" is not intended to limit the present invention to polynucleotides comprising DNA. Those of ordinary skill in the art will recognize that polynucleotides, can comprise ribonucleotides and combinations of ribonucleotides and deoxyribonucleotides. Such deoxyribonucleotides and ribonucleotides include both naturally occurring molecules and synthetic analogues. The polynucleotides of the invention also encompass all forms of sequences including, but not limited to, single-stranded forms, double-stranded forms, hairpins, stem-and-loop structures, and the like.

The polynucleotide constructs comprising R protein coding regions can be provided in expression cassettes for expression in the plant or other organism or non-human host cell of interest. The cassette will include 5' and 3' regulatory sequences operably linked to the R protein coding region. "Operably linked" is intended to mean a functional linkage between two or more elements. For example, an operable linkage between a polynucleotide or gene of interest and a regulatory sequence (i.e., a promoter) is functional link that allows for expression of the polynucleotide of interest. Operably linked elements may be contiguous or non-contiguous. When used to refer to the joining of two protein coding regions, by operably linked is intended that the coding regions are in the same reading frame. The cassette may additionally contain at least one additional gene to be cotransformed into the organism. Alternatively, the additional gene(s) can be provided on multiple expression cassettes. Such an expression cassette is provided with a plurality of restriction sites and/or recombination sites for insertion of the R protein coding region to be under the transcriptional regulation of the regulatory regions. The expression cassette may additionally contain selectable marker genes.

The expression cassette will include in the 5'-3' direction of transcription, a transcriptional and translational initiation region (i.e., a promoter), a R protein coding region of the invention, and a transcriptional and translational termination region (i.e., termination region) functional in plants or other organism or non-human host cell. The regulatory regions (i.e., promoters, transcriptional regulatory regions, and translational termination regions) and/or the R protein coding region or of the invention may be native/analogous to the host cell or to each other. Alternatively, the regulatory regions and/or the R protein coding region of the invention may be heterologous to the host cell or to each other.

As used herein, "heterologous" in reference to a nucleic acid molecule or nucleotide sequence is a nucleic acid molecule or nucleotide sequence that originates from a foreign species, or, if from the same species, is modified from its native form in composition and/or genomic locus by deliberate human intervention. For example, a promoter operably linked to a heterologous polynucleotide is from a species different from the species from which the polynucleotide was derived, or, if from the same/analogous species, one or both are substantially modified from their original form and/or genomic locus, or the promoter is not the native promoter for the operably linked polynucleotide. As used herein, a chimeric gene comprises a coding sequence operably linked to a transcription initiation region that is heterologous to the coding sequence.

The present invention provides host cells comprising at least of the nucleic acid molecules, expression cassettes, and vectors of the present invention. In preferred embodiments of the invention, a host cells is plant cell. In other embodiments, a host cell is selected from the group consisting of a bacterium, a fungal cell, and an animal cell. In certain embodiments, a host cell is non-human animal cell. However, in some other embodiments, the host cell is an in-vitro cultured human cell.

While it may be optimal to express the R protein using heterologous promoters, the native promoter of the corresponding R gene may be used.

The termination region may be native with the transcriptional initiation region, may be native with the operably linked R protein coding region of interest, may be native with the plant host, or may be derived from another source (i.e., foreign or heterologous to the promoter, the R protein of interest, and/or the plant host), or any combination thereof. Convenient termination regions are available from the Ti-plasmid of *A. tumefaciens*, such as the octopine synthase and nopaline synthase termination regions. See also Guerineau et al. (1991)*Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acids Res.* 15:9627-9639.

Where appropriate, the polynucleotides may be optimized for increased expression in the transformed plant. That is, the polynucleotides can be synthesized using plant-preferred codons for improved expression. See, for example, Campbell and Gowri (1990) *Plant Physiol.* 92:1-11 for a discussion of host-preferred codon usage. Methods are available in the art for synthesizing plant-preferred genes. See, for example, U.S. Pat. Nos. 5,380,831, and 5,436,391, and Murray et al. (1989) *Nucleic Acids Res.* 17:477-498, herein incorporated by reference.

Additional sequence modifications are known to enhance gene expression in a cellular host. These include elimination of sequences encoding spurious polyadenylation signals, exon-intron splice site signals, transposon-like repeats, and other such well-characterized sequences that may be deleterious to gene expression. The G-C content of the sequence may be adjusted to levels average for a given cellular host, as calculated by reference to known genes expressed in the host cell. When possible, the sequence is modified to avoid predicted hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein et al. (1989) *Proc. Natl. Acad. Sci. USA* 86:6126-6130); potyvirus leaders, for example, TEV leader (Tobacco Etch Virus) (Gallie et al. (1995) *Gene* 165(2):233-238), MDMV leader (Maize Dwarf Mosaic Virus) (*Virology* 154:9-20), and human immunoglobulin heavy-chain binding protein (BiP) (Macejak et al. (1991) *Nature* 353:90-94); untranslated leader from the coat protein mRNA of alfalfa mosaic virus (AMV RNA 4) (Jobling et al. (1987) *Nature* 325:622-625); tobacco mosaic virus leader (TMV) (Gallie et al. (1989) in *Molecular Biology of RNA*, ed. Cech (Liss, New York), pp. 237-256); and maize chlorotic mottle virus leader (MCMV) (Lommel et al. (1991) *Virology* 81:382-385). See also, Della-Cioppa et al. (1987) *Plant Physiol.* 84:965-968.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used in the practice of the invention. The promoters can be selected based on the desired outcome. The nucleic acids can be combined with constitutive, tissue-preferred, or other promoters for expression in plants. Such constitutive promoters include, for example, the core CaMV 35S promoter (Odell et al. (1985) *Nature* 313:810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); MAS (Velten et al. (1984) *EMBO J.* 3:2723-2730); ALS promoter (U.S. Pat. No. 5,659,026), and the like. Other constitutive promoters include, for example, U.S. Pat. Nos. 5,608,149; 5,608,144; 5,604,121; 5,569,597; 5,466,785; 5,399,680; 5,268,463; 5,608,142; and 6,177,611.

Tissue-preferred promoters can be utilized to target enhanced expression of the R protein coding sequences within a particular plant tissue. Such tissue-preferred promoters include, but are not limited to, leaf-preferred promoters, root-preferred promoters, seed-preferred promoters, and stem-preferred promoters. Tissue-preferred promoters include Yamamoto et al. (1997) *Plant J.* 12(2):255-265; Kawamata et al. (1997) *Plant Cell Physiol.* 38(7):792-803; Hansen et al. (1997) *Mol. Gen Genet.* 254(3):337-343; Russell et al. (1997) *Transgenic Res.* 6(2):157-168; Rinehart et al. (1996) *Plant Physiol.* 112(3):1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol Biol.* 23(6):1129-1138; Matsuoka et al. (1993) *Proc Natl. Acad. Sci. USA* 90(20):9586-9590; and Guevara-Garcia et al. (1993) *Plant J.* 4(3):495-505. Such promoters can be modified, if necessary, for weak expression.

Generally, it will be beneficial to express the gene from an inducible promoter, particularly from a pathogen-inducible promoter. Such promoters include those from pathogenesis-related proteins (PR proteins), which are induced following infection by a pathogen; e.g., PR proteins, SAR proteins, beta-1,3-glucanase, chitinase, etc. See, for example, Redolfi et al. (1983) *Neth. J. Plant Pathol.* 89:245-254; Uknes et al. (1992) *Plant Cell* 4:645-656; and Van Loon (1985) *Plant Mol. Virol.* 4:111-116. See also WO 99/43819, herein incorporated by reference.

Of interest are promoters that are expressed locally at or near the site of pathogen infection. See, for example, Marineau et al. (1987) *Plant Mol. Biol.* 9:335-342; Matton et al. (1989) *Molecular Plant-Microbe Interactions* 2:325-331; Somsisch et al. (1986) *Proc. Natl. Acad. Sci. USA* 83:2427-2430; Somsisch et al. (1988) *Mol. Gen. Genet.* 2:93-98; and Yang (1996) *Proc. Natl. Acad. Sci. USA* 93:14972-14977. See also, Chen et al. (1996) *Plant J.* 10:955-966; Zhang et al. (1994) *Proc. Natl. Acad. Sci. USA* 91:2507-2511; Warner et al. (1993) *Plant J.* 3:191-201; Siebertz et al. (1989) *Plant Cell* 1:961-968; U.S. Pat. No. 5,750,386 (nematode-inducible); and the references cited therein. Of particular interest is the inducible promoter for the maize PRms gene, whose expression is induced by the pathogen *Fusarium moniliforme* (see, for example, Cordero et al. (1992) *Physiol. Mol. Plant Path.* 41:189-200).

Also of interest are the native promoters from other resistance genes from the target species. These promoters are often pathogen-inducible, and are likely to express the resistance gene at appropriate levels and in appropriate tissues. Examples of such promoters are the Sr57lLr34, Sr33, and Sr35 promoters of wheat (Risk et al. (2012) *Plant Biotechnol J* 10: 447-487; Periyannan et al. (2013) *Science* 341: 786-788; Saintenac et al. (2013) *Science* 341: 783-786).

Additionally, as pathogens find entry into plants through wounds or insect damage, a wound-inducible promoter may be used in the constructions of the invention. Such wound-inducible promoters include potato proteinase inhibitor (pin II) gene (Ryan (1990) *Ann. Rev. Phytopath.* 28:425-449; Duan et al. (1996) *Nature Biotechnology* 14:494-498); wun1 and wun2, U.S. Pat. No. 5,428,148; win1 and win2 (Stanford et al. (1989) *Mol. Gen. Genet.* 215:200-208); systemin (McGurl et al. (1992) *Science* 225:1570-1573); WIP1 (Rohmeier et al. (1993) *Plant Mol. Biol.* 22:783-792; Eckelkamp et al. (1993) *FEBS Letters* 323:73-76); MPI gene (Corderok et al. (1994) *Plant J.* 6(2):141-150); and the like, herein incorporated by reference.

Chemical-regulated promoters can be used to modulate the expression of a gene in a plant through the application of an exogenous chemical regulator. Depending upon the objective, the promoter may be a chemical-inducible promoter, where application of the chemical induces gene expression, or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-la promoter, which is activated by salicylic acid. Other chemical-regulated promoters of interest include steroid-responsive promoters (see, for example, the glucocorticoid-inducible promoter in Schena et al. (1991) *Proc. Natl. Acad. Sci. USA* 88:10421-10425 and McNellis et al. (1998) *Plant J.* 14(2):247-257) and tetracycline-inducible and tetracycline-repressible promoters (see, for example, Gatz et al. (1991) *Mol. Gen. Genet.* 227:229-237, and U.S. Pat. Nos. 5,814,618 and 5,789,156), herein incorporated by reference.

The expression cassette can also comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). Additional selectable markers include phenotypic markers such as β-galactosidase and fluorescent proteins such as green fluorescent protein (GFP) (Su et al. (2004) *Biotechnol Bioeng* 85:610-9 and Fetter et al. (2004) *Plant Cell* 16:215-28), cyan florescent protein (CYP) (Bolte et al. (2004) *J. Cell Science* 117:943-54 and Kato et al. (2002) *Plant Physiol* 129:913-42), and yellow florescent protein (PhiYFP™ from Evrogen, see, Bolte et al. (2004) *J. Cell Science* 117:943-54). For additional selectable markers, see generally, Yarranton (1992) *Curr. Opin. Biotech.* 3:506-511; Christopherson et al. (1992) *Proc. Natl. Acad. Sci. USA* 89:6314-6318; Yao et al. (1992) *Cell* 71:63-72; Reznikoff (1992) *Mol. Microbiol.* 6:2419-2422; Barkley et al. (1980) in *The Operon*, pp. 177-220; Hu et al. (1987) *Cell* 48:555-566; Brown et al. (1987) *Cell* 49:603-612; Figge et al. (1988) *Cell* 52:713-722; Deuschle et al. (1989) *Proc. Natl. Acad. Aci. USA* 86:5400-5404; Fuerst et al. (1989) *Proc. Natl. Acad. Sci. USA* 86:2549-2553; Deuschle et al. (1990) *Science* 248:480-483; Gossen (1993) Ph.D. Thesis, University of Heidelberg; Reines et al. (1993) *Proc. Natl. Acad. Sci. USA* 90:1917-1921; Labow et al. (1990)*Mol. Cell. Biol.* 10:3343-3356; Zambretti et al. (1992) *Proc. Natl. Acad. Sci. USA* 89:3952-3956; Baim et al. (1991) *Proc. Natl. Acad. Sci. USA* 88:5072-5076; Wyborski et al. (1991) *Nucleic Acids Res.* 19:4647-4653; Hillenand-Wissman (1989) *Topics Mol. Struc. Biol.* 10:143-162; Degenkolb et al. (1991) *Antimicrob. Agents Chemother.* 35:1591-1595; Kleinschnidt et al. (1988) *Biochemistry* 27:1094-1104; Bonin (1993) Ph.D. Thesis, University of Heidelberg; Gossen et al. (1992) *Proc. Natl. Acad. Sci. USA* 89:5547-5551; Oliva et al. (1992) *Antimicrob. Agents Chemother.* 36:913-919; Hlavka et al. (1985) *Handbook of Experimental Pharmacology*, Vol. 78 (Springer-Verlag, Berlin); Gill et al. (1988) *Nature* 334:721-724. Such disclosures are herein incorporated by reference.

The above list of selectable marker genes is not intended to be limiting. Any selectable marker gene can be used in the present invention.

Numerous plant transformation vectors and methods for transforming plants are available. See, for example, An, G. et al. (1986) *Plant Pysiol.*, 81:301-305; Fry, J., et al. (1987) *Plant Cell Rep.* 6:321-325; Block, M. (1988) *Theor. Appl Genet.* 76:767-774; Hinchee, et al. (1990) *Stadler. Genet. Symp.* 203212.203-212; Cousins, et al. (1991) *Aust. J. Plant Physiol.* 18:481-494; Chee, P. P. and Slightom, J. L. (1992) *Gene.* 118:255-260; Christou, et al. (1992) *Trends. Biotechnol.* 10:239-246; D'Halluin, et al. (1992) *Bio/Technol.* 10:309-314; Dhir, et al. (1992) *Plant Physiol.* 99:81-88; Casas et al. (1993) *Proc. Nat. Acad Sci. USA* 90:11212-11216; Christou, P. (1993) *In Vitro Cell. Dev. Biol.*-Plant; 29P:119-124; Davies, et al. (1993) *Plant Cell Rep.* 12:180-183; Dong, J. A. and Mchughen, A. (1993) *Plant Sci.* 91:139-148; Franklin, C. I. and Trieu, T. N. (1993) *Plant. Physiol.* 102:167; Golovkin, et al. (1993) *Plant Sci.* 90:41-52; Guo Chin Sci. Bull. 38:2072-2078; Asano, et al. (1994) *Plant Cell Rep.* 13; Ayeres N. M. and Park, W. D. (1994) *Crit. Rev. Plant. Sci.* 13:219-239; Barcelo, et al. (1994) *Plant. J.* 5:583-592; Becker, et al. (1994) *Plant. J.* 5:299-307; Borkowska et al. (1994) *Acta. Physiol Plant.* 16:225-230; Christou, P. (1994) *Agro. Food. Ind. Hi Tech.* 5: 17-27; Eapen et al. (1994) *Plant Cell Rep.* 13:582-586; Hartman, et al. (1994) *Bio-Technology* 12: 919923; Ritala, et al. (1994) *Plant. Mol. Biol.* 24:317-325; and Wan, Y. C. and Lemaux, P. G. (1994) *Plant Physiol.* 104:3748.

The methods of the invention involve introducing a polynucleotide construct into a plant. By "introducing" is intended presenting to the plant the polynucleotide construct in such a manner that the construct gains access to the interior of a cell of the plant. The methods of the invention do not depend on a particular method for introducing a polynucleotide construct to a plant, only that the polynucleotide construct gains access to the interior of at least one cell of the plant. Methods for introducing polynucleotide constructs into plants are known in the art including, but not limited to, stable transformation methods, transient transformation methods, and virus-mediated methods.

By "stable transformation" is intended that the polynucleotide construct introduced into a plant integrates into the genome of the plant and is capable of being inherited by progeny thereof. By "transient transformation" is intended that a polynucleotide construct introduced into a plant does not integrate into the genome of the plant.

For the transformation of plants and plant cells, the nucleotide sequences of the invention are inserted using standard techniques into any vector known in the art that is suitable for expression of the nucleotide sequences in a plant or plant cell. The selection of the vector depends on the preferred transformation technique and the target plant species to be transformed.

Methodologies for constructing plant expression cassettes and introducing foreign nucleic acids into plants are generally known in the art and have been previously described. For example, foreign DNA can be introduced into plants, using tumor-inducing (Ti) plasmid vectors. Other methods utilized for foreign DNA delivery involve the use of PEG mediated protoplast transformation, electroporation, microinjection whiskers, and biolistics or microprojectile bombardment for direct DNA uptake. Such methods are known in the art. (U.S. Pat. No. 5,405,765 to Vasil et al.; Bilang et al. (1991) *Gene* 100: 247-250; Scheid et al., (1991) *Mol. Gen. Genet.*, 228: 104-112; Guerche et al., (1987) *Plant Science* 52: 111-116; Neuhause et al., (1987) *Theor. Appl Genet.* 75: 30-36; Klein et al., (1987) *Nature* 327: 70-73; Howell et al., (1980) *Science* 208:1265; Horsch et al., (1985) *Science* 227: 1229-1231; DeBlock et al., (1989) *Plant Physiology* 91: 694-701; *Methods for Plant Molecular Biology* (Weissbach and Weissbach, eds.) Academic Press, Inc. (1988) and *Methods in Plant Molecular Biology* (Schuler and Zielinski, eds.) Academic Press, Inc. (1989). The method of transformation depends upon the plant cell to be transformed, stability of vectors used, expression level of gene products and other parameters.

Other suitable methods of introducing nucleotide sequences into plant cells and subsequent insertion into the plant genome include microinjection as Crossway et al. (1986) *Biotechniques* 4:320-334, electroporation as described by Riggs et al. (1986) *Proc. Natl. Acad. Sci. USA* 83:5602-5606, *Agrobacterium*-mediated transformation as described by Townsend et al., U.S. Pat. No. 5,563,055, Zhao et al., U.S. Pat. No. 5,981,840, direct gene transfer as described by Paszkowski et al. (1984) *EMBO J.* 3:2717-2722, and ballistic particle acceleration as described in, for example, Sanford et al., U.S. Pat. No. 4,945,050; Tomes et al., U.S. Pat. No. 5,879,918; Tomes et al., U.S. Pat. No. 5,886,244; Bidney et al., U.S. Pat. No. 5,932,782; Tomes et al. (1995) "Direct DNA Transfer into Intact Plant Cells via Microprojectile Bombardment," in *Plant Cell, Tissue, and Organ Culture: Fundamental Methods*, ed. Gamborg and Phillips (Springer-Verlag, Berlin); McCabe et al. (1988) *Biotechnology* 6:923-926); and Lec1 transformation (WO 00/28058). Also see, Weissinger et al. (1988) *Ann. Rev. Genet.* 22:421-477; Sanford et al. (1987) *Particulate Science and Technology* 5:27-37 (onion); Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P:175-182 (soybean); Singh et al. (1998) *Theor. Appl. Genet.* 96:319-324 (soybean); Datta et al. (1990) *Biotechnology* 8:736-740 (rice); Klein et al. (1988) *Proc. Natl. Acad. Sci. USA* 85:4305-4309 (maize); Klein et al. (1988) *Biotechnology* 6:559-563 (maize); Tomes, U.S. Pat. No. 5,240,855; Buising et al., U.S. Pat. Nos. 5,322,783 and 5,324,646; Tomes et al. (1995) "Direct DNA Transfer into Intact Plant Cells via Microprojectile Bombardment," in *Plant Cell, Tissue, and Organ Culture: Fundamental Methods*, ed. Gamborg (Springer-Verlag, Berlin) (maize); Klein et al. (1988) *Plant Physiol.* 91:440-444 (maize); Fromm et al. (1990) *Biotechnology* 8:833-839 (maize); Hooykaas-Van Slogteren et al. (1984) *Nature* (London) 311:763-764; Bowen et al., U.S. Pat. No. 5,736,369 (cereals); Bytebier et al. (1987) *Proc. Natl. Acad. Sci. USA* 84:5345-5349 (Liliaceae); De Wet et al. (1985) in *The Experimental Manipulation of Ovule Tissues, ed.* Chapman et al. (Longman, N.Y.), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation); Li et al. (1993) *Plant Cell Reports* 12:250-255 and Christou and Ford (1995) *Annals of Botany* 75:407-413 (rice); Osjoda et al. (1996) *Nature Biotechnology* 14:745-750 (maize via *Agrobacterium tumefaciens*); all of which are herein incorporated by reference.

The polynucleotides of the invention may be introduced into plants by contacting plants with a virus or viral nucleic acids. Generally, such methods involve incorporating a polynucleotide construct of the invention within a viral DNA or RNA molecule. Further, it is recognized that promoters of the invention also encompass promoters utilized for transcription by viral RNA polymerases. Methods for introducing polynucleotide constructs into plants and expressing a protein encoded therein, involving viral DNA or RNA molecules, are known in the art. See, for example, U.S. Pat. Nos. 5,889,191, 5,889,190, 5,866,785, 5,589,367 and 5,316,931; herein incorporated by reference.

If desired, the modified viruses or modified viral nucleic acids can be prepared in formulations. Such formulations are prepared in a known manner (see e.g. for review U.S. Pat. No. 3,060,084, EP-A 707 445 (for liquid concentrates), Browning, "Agglomeration", Chemical Engineering, Dec. 4, 1967, 147-48, Perry's Chemical Engineer's Handbook, 4th Ed., McGraw-Hill, New York, 1963, pages 8-57 and et seq. WO 91/13546, U.S. Pat. Nos. 4,172,714, 4,144,050, 3,920,442, 5,180,587, 5,232,701, 5,208,030, GB 2,095,558, U.S. Pat. No. 3,299,566, Klingman, Weed Control as a Science, John Wiley and Sons, Inc., New York, 1961, Hance et al. Weed Control Handbook, 8th Ed., Blackwell Scientific Publications, Oxford, 1989 and Mollet, H., Grubemann, A., Formulation technology, Wiley VCH Verlag GmbH, Weinheim (Germany), 2001, 2. D. A. Knowles, Chemistry and Technology of Agrochemical Formulations, Kluwer Academic Publishers, Dordrecht, 1998 (ISBN 0-7514-0443-8), for example by extending the active compound with auxiliaries suitable for the formulation of agrochemicals, such as solvents and/or carriers, if desired emulsifiers, surfactants and dispersants, preservatives, antifoaming agents, antifreezing agents, for seed treatment formulation also optionally colorants and/or binders and/or gelling agents.

In specific embodiments, the polynucleotide constructs and expression cassettes of the invention can be provided to a plant using a variety of transient transformation methods known in the art. Such methods include, for example, microinjection or particle bombardment. See, for example, Crossway et al. (1986) *Mol Gen. Genet.* 202:179-185; Nomura et al. (1986) *Plant Sci.* 44:53-58; Hepler et al. (1994) *PNAS Sci.* 91: 2176-2180 and Hush et al. (1994) *J. Cell Science* 107:775-784, all of which are herein incorporated by reference. Alternatively, the polynucleotide can be transiently transformed into the plant using techniques known in the art. Such techniques include viral vector system and *Agrobacterium tumefaciens*-mediated transient expression as described elsewhere herein.

The cells that have been transformed may be grown into plants in accordance with conventional ways. See, for example, McCormick et al. (1986) *Plant Cell Reports* 5:81-84. These plants may then be grown, and either pollinated with the same transformed strain or different strains, and the resulting hybrid having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a polynucleotide construct of the invention, for example, an expression cassette of the invention, stably incorporated into their genome.

Any methods known in the art for modifying DNA in the genome of a plant can be used to alter the coding sequences of an R gene in planta, e.g. to alter the nucleotide sequence of a homologous susceptible allele to that of an allele that provides resistance to at least one race of stem rust. Such methods include genome editing techniques, such as, for example, methods involving targeted mutagenesis, homologous recombination, and mutation breeding. Targeted mutagenesis or similar techniques are disclosed in U.S. Pat. Nos. 5,565,350; 5,731,181; 5,756,325; 5,760,012; 5,795,972, 5,871,984, and 8,106,259; all of which are herein incorporated in their entirety by reference. Methods for gene modification or gene replacement comprising homologous recombination can involve inducing double breaks in DNA using zinc-finger nucleases (ZFN), TAL (transcription activator-like) effector nucleases (TALEN), Clustered Regularly Interspaced Short Palindromic Repeats/CRISPR-associated nuclease (CRISPR/Cas nuclease), or homing endonucleases that have been engineered endonucleases to make double-strand breaks at specific recognition sequences in the genome of a plant, other organism, or host cell. See, for example, Durai et al., (2005) *Nucleic Acids Res* 33:5978-90; Mani et al. (2005) *Biochem Biophys Res Comm* 335:447-57; U.S. Pat. Nos. 7,163,824, 7,001,768, and 6,453,242; Arnould et al. (2006) *J Mol Biol* 355:443-58; Ashworth et al., (2006) *Nature* 441:656-9; Doyon et al. (2006) *J Am Chem Soc* 128:2477-84; Rosen et al., (2006) *Nucleic Acids Res* 34:4791-800; and Smith et al., (2006) *Nucleic Acids Res* 34:e149; U.S. Pat. App. Pub. No. 2009/0133152; and U.S. Pat. App. Pub. No. 2007/0117128; all of which are herein incorporated in their entirety by reference.

TAL effector nucleases (TALENs) can be used to make double-strand breaks at specific recognition sequences in the genome of a plant for gene modification or gene replacement through homologous recombination. TAL effector nucleases are a class of sequence-specific nucleases that can be used to make double-strand breaks at specific target sequences in the genome of a plant or other organism. TAL effector nucleases are created by fusing a native or engineered transcription activator-like (TAL) effector, or functional part thereof, to the catalytic domain of an endonuclease, such as, for example, FokI. The unique, modular TAL effector DNA binding domain allows for the design of proteins with potentially any given DNA recognition specificity. Thus, the DNA binding domains of the TAL effector nucleases can be engineered to recognize specific DNA target sites and thus, used to make double-strand breaks at desired target sequences. See, WO 2010/079430; Morbitzer et al. (2010) *PNAS* 10.1073/pnas.1013133107; Scholze and Boch (2010) *Virulence* 1:428-432; Christian et al. *Genetics* (2010) 186: 757-761; Li et al. (2010) *Nuc. Acids Res.* (2010) doi: 10.1093/nar/gkq704; and Miller et al. (2011) *Nature Biotechnology* 29:143-148; all of which are herein incorporated by reference.

The CRISPR/Cas nuclease system can also be used to make double-strand breaks at specific recognition sequences in the genome of a plant for gene modification or gene replacement through homologous recombination. The CRISPR/Cas nuclease is an RNA-guided (simple guide RNA, sgRNA in short) DNA endonuclease system performing sequence-specific double-stranded breaks in a DNA segment homologous to the designed RNA. It is possible to design the specificity of the sequence (Cho S. W. et al., Nat. Biotechnol. 31:230-232, 2013; Cong L. et al., Science 339:819-823, 2013; Mali P. et al., Science 339:823-826, 2013; Feng Z. et al., Cell Research: 1-4, 2013).

In addition, a ZFN can be used to make double-strand breaks at specific recognition sequences in the genome of a plant for gene modification or gene replacement through homologous recombination. The Zinc Finger Nuclease (ZFN) is a fusion protein comprising the part of the FokI restriction endonuclease protein responsible for DNA cleavage and a zinc finger protein which recognizes specific, designed genomic sequences and cleaves the double-stranded DNA at those sequences, thereby producing free DNA ends (Urnov F. D. et al., Nat Rev Genet. 11:636-46, 2010; Carroll D Genetics. 188:773-82, 2011).

Breaking DNA using site specific nucleases, such as, for example, those described herein above, can increase the rate of homologous recombination in the region of the breakage. Thus, coupling of such effectors as described above with nucleases enables the generation of targeted changes in genomes which include additions, deletions and other modifications.

The nucleic acid molecules, expression cassettes, vectors, and polynucleotide constructs of the present invention may be used for transformation of any plant species, including, but not limited to, monocots and dicots. Preferred plants of the present invention are wheat plants. Examples of other plant species of interest include, but are not limited to, peppers (*Capsicum* spp; e.g., *Capsicum annuum, C. baccatum, C. chinense, C. frutescens, C. pubescens*, and the like), tomatoes (*Lycopersicon esculentum*), tobacco (*Nicotiana tabacum*), eggplant (*Solanum melongena*), *petunia* (*Petunia* spp., e.g., *Petunia×hybrida* or *Petunia hybrida*), pea (*Pisum sativum*), bean (*Phaseolus vulgaris*), corn or maize (*Zea mays*), *Brassica* sp. (e.g., *B. napus, B. rapa, B. juncea*), particularly those *Brassica* species useful as sources of seed oil, alfalfa (*Medicago saliva*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (Carthamus tinctorius), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus* casica), guava (*Psidium guajava*), mango (*Mangifera indica*), olive (*Olea europaea*), *papaya*

(*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), palms, oats, barley, vegetables, ornamentals, and conifers.

As used herein, the term "plant" includes plant cells, plant protoplasts, plant cell tissue cultures from which plants can be regenerated, plant calli, plant clumps, and plant cells that are intact in plants or parts of plants such as embryos, pollen, ovules, seeds, tubers, propagules, leaves, flowers, branches, fruits, roots, root tips, anthers, and the like. Progeny, variants, and mutants of the regenerated plants are also included within the scope of the invention, provided that these parts comprise the introduced polynucleotides. As used herein, "progeny" and "progeny plant" comprise any subsequent generation of a plant whether resulting from sexual reproduction and/or asexual propagation, unless it is expressly stated otherwise or is apparent from the context of usage.

In some embodiments of the present invention, a plant cell is transformed with a polynucleotide construct encoding an R protein of the present invention. The term "expression" as used herein refers to the biosynthesis of a gene product, including the transcription and/or translation of said gene product. The "expression" or "production" of a protein or polypeptide from a DNA molecule refers to the transcription and translation of the coding sequence to produce the protein or polypeptide, while the "expression" or "production" of a protein or polypeptide from an RNA molecule refers to the translation of the RNA coding sequence to produce the protein or polypeptide. Examples of polynucleotide constructs and nucleic acid molecules that encode R proteins are described elsewhere herein.

The use of the terms "DNA" or "RNA" herein is not intended to limit the present invention to polynucleotide molecules comprising DNA or RNA. Those of ordinary skill in the art will recognize that the methods and compositions of the invention encompass polynucleotide molecules comprised of deoxyribonucleotides (i.e., DNA), ribonucleotides (i.e., RNA) or combinations of ribonucleotides and deoxyribonucleotides. Such deoxyribonucleotides and ribonucleotides include both naturally occurring molecules and synthetic analogues including, but not limited to, nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs). The polynucleotide molecules of the invention also encompass all forms of polynucleotide molecules including, but not limited to, single-stranded forms, double-stranded forms, hairpins, stem-and-loop structures, and the like. Furthermore, it is understood by those of ordinary skill in the art that the nucleotide sequences disclosed herein also encompasses the complement of that exemplified nucleotide sequence.

The invention is drawn to compositions and methods for enhancing the resistance of a plant to plant disease, particularly to compositions and methods for enhancing the resistance of a wheat plant to wheat stem rust. By "disease resistance" is intended that the plants avoid the disease symptoms that are the outcome of plant-pathogen interactions. That is, pathogens are prevented from causing plant diseases and the associated disease symptoms, or alternatively, the disease symptoms caused by the pathogen is minimized or lessened.

The present invention encompasses the polynucleotide constructs disclosed herein or in the accompanying sequence listing and/or drawings including, but not limited to, SEQ ID NOS: 138, 139, 140, 141, 142, 143, 144, 145, 146, 147, 148, 149, 150, 151, 152, 153, 154, 155, 156, 157, 158, 159, 160, 161, and 162. The present invention further encompasses plants, plant cells, host cells, and vectors comprising at least one of such polynucleotide constructs, as well as food products produced from such plants. Additionally encompassed by the present invention are uses of plants comprising at least one of such polynucleotide constructs in the methods disclosed elsewhere herein such as, for example, methods for enhancing the resistance of a wheat plant to wheat stem rust and methods of limiting wheat stem rust in agricultural crop production.

The following examples are offered by way of illustration and not by way of limitation.

EXAMPLES

Example 1: Genetic Mapping of Sr22 and Sr45

Figure 3:
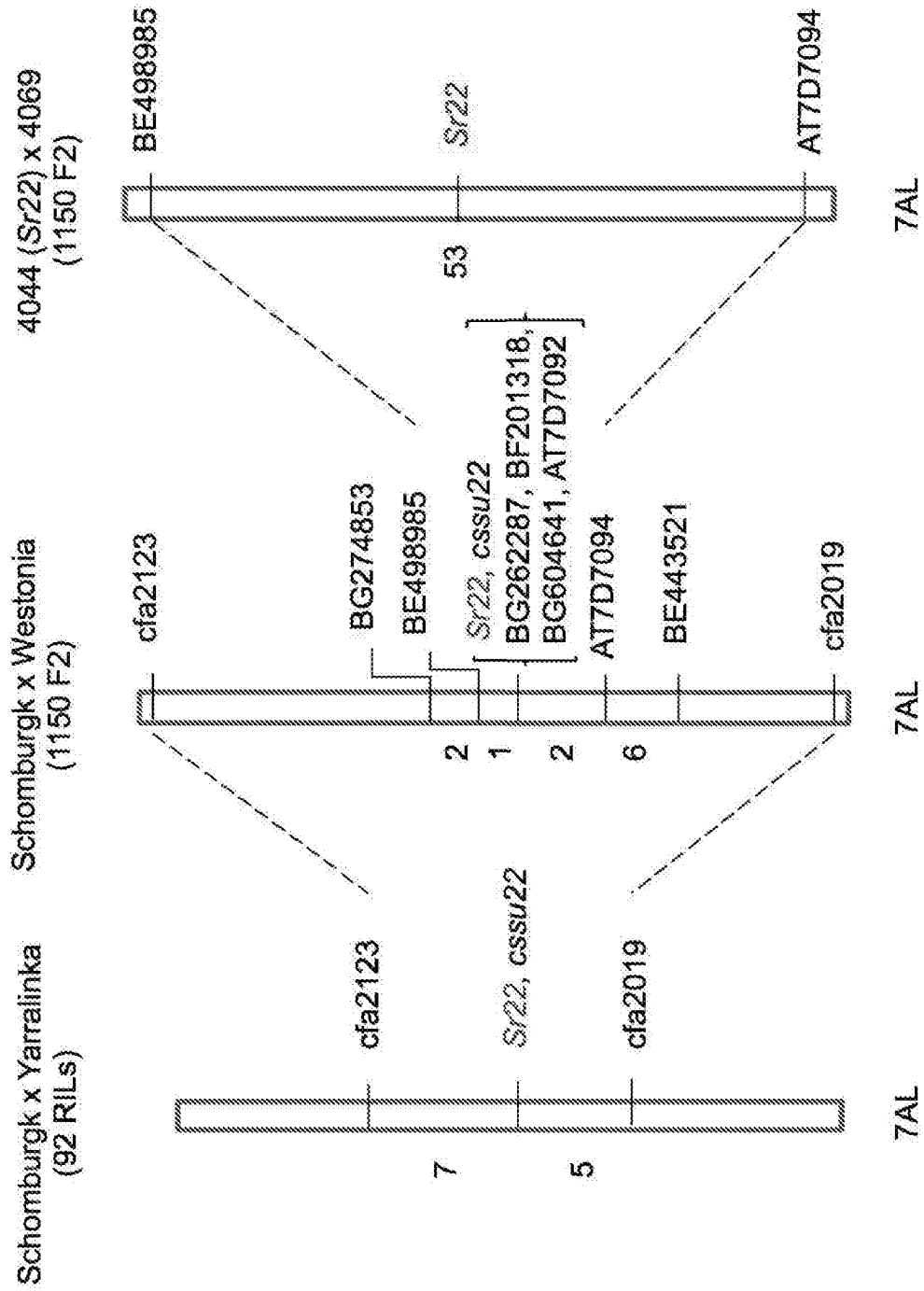
FIG. 3. Linkage of markers around Sr22 in hexaploid wheat (*Triticum aestivum*).

Sr22 was introgressed into wheat chromosome 7A from the diploid A-genome relative *T. boeoticum* (Gerechter-Amitai et al. (1971) *Euphytica* 20:281-285; The (1973) *Nature-New Biol.* 241:256). In the cultivar Schomburgk Sr22 confers resistance to commercially important races of stem rust worldwide including the Ug99 race group, and is one of the few resistance genes effective against Yemeni and Ethiopian isolates (FIG. 1; Table 1). However, deployment of Sr22 has been limited due to poor agronomic performance conferred by linked gene alleles (The et al. (1988) *Proceedings of 7th International Wheat Genetics Symposium*, Miller and Koebner eds., Bath Press, Bath, UK, pp. 901-909), and our attempts to clone Sr22 in wheat with a standard map-based approach were thwarted due to suppressed recombination (FIG. 3).

We generated a mapping population by crossing Schomburgk, the hexaploid wheat line carrying Sr22 from *Triticum boeoticum* accession G-21 (Paull et al. (1994) *Theor. Appl. Genet.* 89:1039-1045), to the stem rust susceptible cultivar Westonia. We screened 1150 $F_2$ seeds with the closely linked flanking SSR markers cfa2123 and cfa2019 (Khan et al. (2005) *Theor. Appl. Genet.* 111:846-850) as per the method of Kota et al. (Kota et al. (2006) *Theor. Appl. Genet.* 112:492-499), and identified 180 recombinants. Seeds of the selected recombinants were advanced to the $F_3$ generation and tested for rust response using the method and isolates described in Periyannan et al. (Periyannan et al. (2011) *Theor. Appl. Genet.* 122:1-7). The DNA of the 180 recombinant lines were subsequently screened with cssu22 (Periyannan et al. (2011) *Theor. Appl. Genet.* 122:1-7), the chromosome 7A specific wheat expressed sequence tags (wESTs) BE443521, BG274853, BE498985, BG262287, BF201318, BG604641 (Akhunov et al. (2010) *BMC Genomics* 11:702), and the markers AT7D7092 and AT7D7094 derived from the homoeologous chromosome 7D (Luo et al. (2013) *PNAS* 110:7940-7945). Markers BG274853 and BE498985 were found to be distal and separated from Sr22 by three and one recombination events, respectively, while markers BE443521 and AT7D7094 were found to be proximal and separated from Sr22 by eight and two recombination events, respectively. The remaining markers, cssu22, BG262287, BF201318 and BG604641, were found to co-segregate with Sr22 (FIG. 3).

In addition to the hexaploid population, the mapping of the Sr22 locus was complemented using 1150 $F_2$ plants derived from the cross between the *T. monococcum* accession PI190945 (carrying Sr22) (Rouse and Jin (2011) *Phytopathology* 101:1418-1423) and the stem rust susceptible accession PI272557. We used the markers BE498985 and AT7D7094 and recovered recombinants (FIG. 3). The presence or absence of Sr22 in the recombinants was verified by screening with *Puccinia graminis* f. sp. *tritici* isolate 06ND76C (race QFCSC) that was characterized to be avirulent to lines with Sr22 (Rouse and Jin (2011) *Phytopathology* 101:1418-1423). None of the co-segregating markers from the Schomburgk×Westonia population were found to be polymorphic between PI190945 and PI272557.

TABLE 1

Stem Rust Infection Types (IT) of Sr22TB (Schomburgk) and *T. monococcum* (PI190945) Carrying Sr22 Against a Worldwide Collection of Stem Rust Isolates

| Stem rust pathotypes* | Sr22TB (Schomburgk)# | PI190945 | PI272557 |
|---|---|---|---|
| TTKSK (Ug99) | 2− | 1 | 4 |
| TTKST (Ug99 + Sr24) | 2− | Not available | Not available |
| TTTTF | 2 | 2− | 4 |
| TRTTF | Not available | 1; | 3+ |
| TPMKC | 2 | Not available | Not available |
| QFCSC | ;2− | ;1− | 4 |
| MCCFC | 2− | ;1 | 4 |
| Australian stem rust race^ 98-1,2,3,5 and 6 | 2− (Schomburgk) | 2− | 3+ |

*Race details and infection types are from Rouse and Jin 2011. Lines with infection scores; and 0 to 2+ (high to low levels of resistance, respectively) were classified as resistant while scores above 3 were grouped as susceptible lines (*Phytopathology* 101: 1418-1423; *Plant Dis*. 95: 941-944) and Olson et al. 2010 (*Crop Science* 50: 1823-1830).
Sr22TB and Schomburgk carry Sr22 from the same sources (*T. boeoticum* accession G-21) (Paull et al. (1994) *Theor. Appl. Genet*. 89: 1039-1045; Olson et al. (2010) *Crop Science* 50: 1823-1830).
^Similar to the resistance response against race 98-1,2,3,5 and 6, the hexaploid line Schomburgk also showed similar infection types against additional Australian stem rust races namely, 34-1,2,3,4,5,6,7; 34-1,2,3,6,7,8,9; 34-1,2,3,5,7,8,9; 34-1,2,7 + Sr38; 40-1, 2,3,4,5,6,7; 98-1,2,3,5,6,7 and 17-1,2,3,7 when compared to the susceptible line Morocco with infection type 3+.

Figure 4:
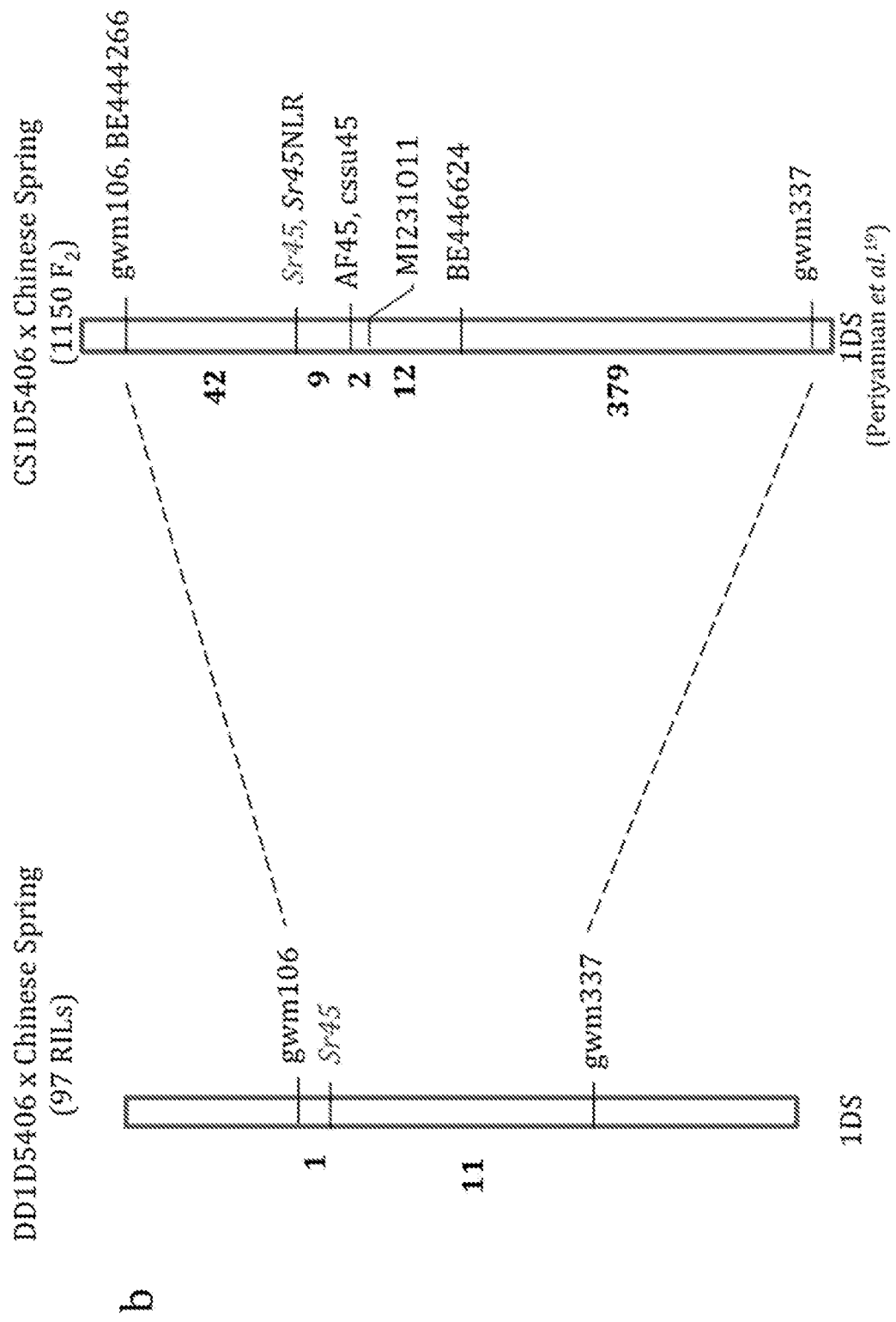
FIG. 4. Linkage of markers around Sr45 in hexaploid wheat.

For mapping Sr45, the high resolution mapping population (CS1D5406×Chinese Spring) described in Periyannan et al. (2014) *Theor. Appl. Genet*. 127:947-955 was used. Parental wheat lines CS1D5406 (Chinese Spring 1D substitution carrying Sr45; Jones et al. (1991) *Genome* 34:505-508) and Chinese Spring (CS— susceptible parent) were crossed to generate a high resolution mapping family of 1150 $F_2$ seeds. Four hundred and twenty one $F_2$ seeds from the CS1D5406/CS high resolution mapping family were recombinant between the simple sequence repeat markers gwm106 and gwm337 and were used to construct the linkage map for Sr45. The embryo sections of the 421 seeds were advanced to $F_3$ and phenotyped for seedling resistance. Using additional wheat EST based markers, BE444266 and BE446624, the Sr45 interval was further narrowed to 23 recombinants (FIG. 4). In the absence of closely linked ESTs, AFLP analysis using selective amplification primer pair PstI+ATT and MseI+GAA amplified a fragment associated with the resistant lines and was mapped (AFLP marker AF45) proximally to Sr45 at a distance of 0.39 cM. The closely linked (AF45) linked fragment was used to identify the BAC clone HB079K08 that formed part of the contig ctg2981 (from the wheat D genome physical mapping project at University of California, Davis) from which a sequence tagged marker, cssu45, diagnostic for Sr45 was developed (Periyannan et al., 2014 *Theor Appl Genet* 127: 947-955).

Example 2: Use of Ren-Seq+EMS to Clone Resistance Genes from Large Genomes

A three-step method was employed for the rapid cloning of an R gene based on (i) chemical mutagenesis and screening for susceptible mutants, (ii) exome capture and next-generation sequencing, followed by (iii) sequence comparison of wildtype and mutants. As described below, this three-step method was used to clone the broad-spectrum stem rust resistance genes Sr22 and Sr45 from the 17 Gb hexaploid bread wheat genome.

The majority of plant R genes belong to the structural class of genes that encode nucleotide-binding and leucine-rich repeat (NB-LRR) domains (Dangl et al. (2013) *Science* 341:746-751). A typical plant genome contains hundreds of NB-LRR homologues (the "NB-LRRome"), most of which reside in complex clusters (Hulbert et al. (2011) *Annu. Rev. Phytopathol*. 39:285-312). R gene enrichment sequencing (RenSeq) of this smaller, specific region of a plant genome is possible by capturing fragments from an Illumina library using biotinylated RNA oligonucleotides designed to be complementary to the NB-LRR gene repertoire of a reference genome (Jupe et al. (2013) *Plant J.* 76, 530-544). Importantly, RenSeq applied to a potato population segregating for disease resistance allowed identification of trait-linked single nucleotide polymorphisms (SNPs) in NB-LRRs (Jupe et al. (2013) *Plant J.* 76, 530-544). More recently, a RenSeq-type approach, which is known as "RenSeq+EMS" was used to identify an R gene from wheat by using, instead of two different cultivars in an NB-LRRome comparison, near-isogenic variation obtained by screening an ethyl methane sulphonate (EMS)-mutagenized population (derived from a single resistant parent) for susceptible mutants (U.S. patent application Ser. No. 14/667, 116 filed Feb. 20, 2015 and PCT/US2015/016792 filed Feb. 20, 2015; both of which are herein incorporated by reference in their entirety). By using RenSeq+EMS, it is relatively straightforward to obtain such mutants since R gene suppressor screens typically yield mutations in the R gene about 90% of mutants rather than in second-site suppressor genes (B. Wulff, unpublished analysis).

Example 3: Generation of an EMS Mutant Population

Figure 2:
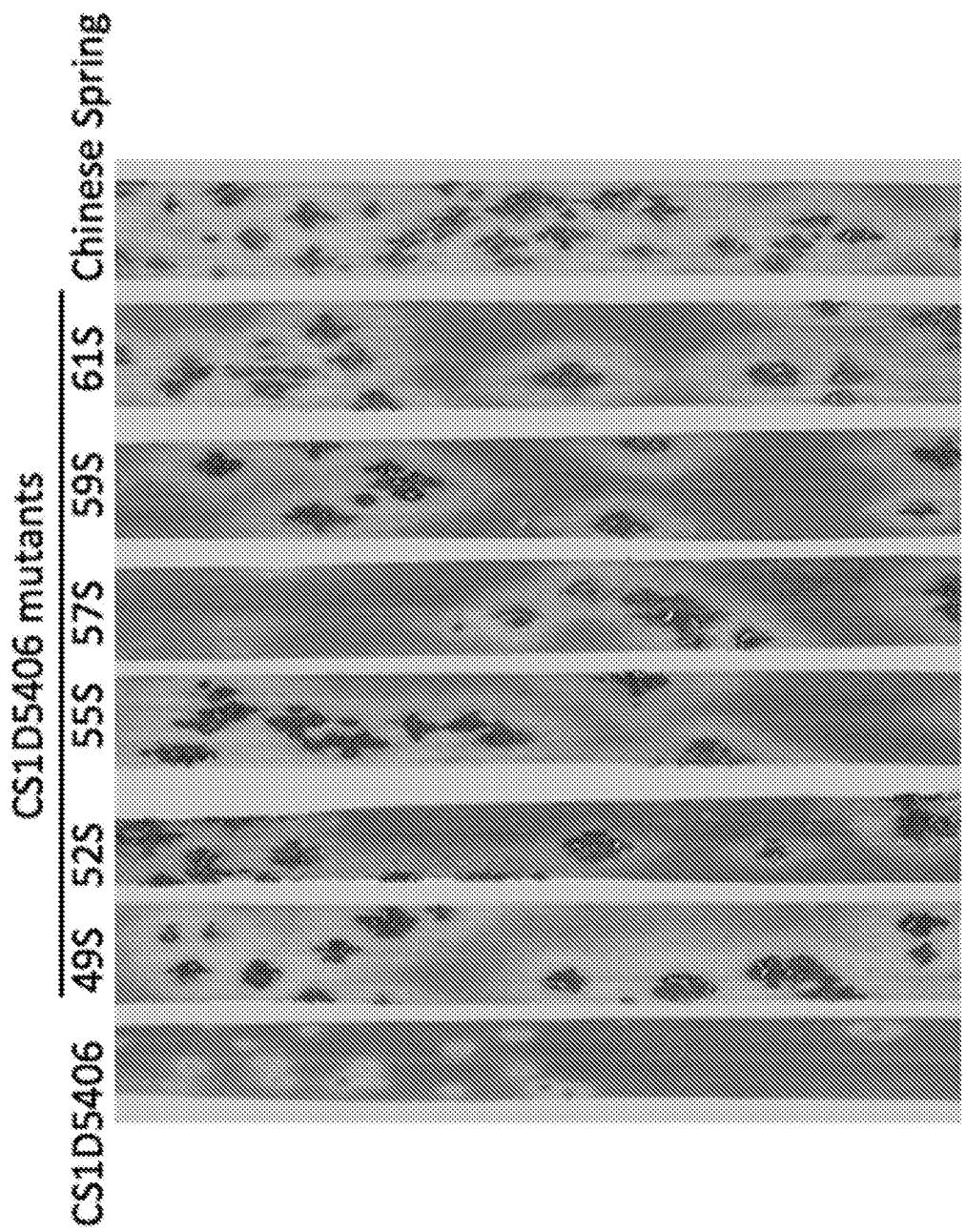
FIG. 2. Stem rust infection phenotype of CS1D5406 (Sr45), EMS-induced susceptible mutants, and the susceptible check Chinese Spring.

We performed EMS mutagenesis as described by Periyannan et al. (Periyannan et al. (2013) *Science* 341:786-788) on seeds of Schomburgk (carrying Sr22) and CS1D5406 (carrying Sr45). In the kill-curve analysis, 0.3% EMS was identified as the optimum dose to cause 50% mortality and reduced growth. We then treated 2,000 and 3,000 seeds of CS1D5406 and Schomburgk, respectively with this concentration and advanced the plants to the $M_2$ generation. We harvested 680 and 1300 single heads ($M_2$ families from EMS treated CS1D5406 and Schomburgk) and screened these for response to Australian stem rust race 40-1,2,3,4, 5,6,7 (PBI culture number 383). From the rust screening of different $M_2$ families, we identified six susceptible mutants (1S, 2S, 3S1, 5S1, 6S, and 7S1) for Sr22 (FIG. 1) and 6 mutants (49S1, 52S1, 55S1, 57S1, 59S1 and 61S1) for Sr45 that were re-confirmed in the $M_3$ generation (FIG. 2).

Example 4: Design of Enrichment Library

We designed 60,000 baits of 120 nucleotides using a proprietary script from MYcroarray (see on the world-wide web: mycroarray.com/). Source sequences were derived from publicly available gene annotations (International Wheat Genome Sequencing Consortium (2014) *Science* 345:1251788; Mayer et al. (2012) *Nature* 491:711-716) and additional genomic raw data of Ae. *sharonensis* (EBI|PR-JEB5333). In case of Ae. *sharonensis* we used RNASeq data (EBI|PRJEB5340) to de novo predict gene models according to Mayer et al. (Mayer et al. (2012) *Nature* 491:711-716). We included all genes containing an NB-ARC (Pfam|PF00931) domain being aware that this may include additional gene families. Translated protein sequences were screened for NB-ARC domains using pfam_scan (Finn et al. (2014) *Nuc. Acids Res.* 42:D222-230). All predicted exons belonging to a selected gene were added to the set of source sequences. Exons shorter than 120 bp were elongated by 60 bp up- and downstream. Resulting sequences were further refined by (i) screening for repetitive elements using Repeat-Masker (available on the world-wide web at: repeatmasker.org/) and the Triticeae Repeat library TREP (available on the world-wide web at: wheat.pw.usda.gov/ITMI/Repeats/), (ii) clustering using CD-HIT (Fu et al. (2012) *Bioinformatics* 28:3150-3152) (identity threshold 95%) to remove redundant sequences, and (iii) sequences were ensured to have no reverse complementary motifs. This latter step was achieved by aligning all sequences against all sequences using BLASTn (Zhang et al. (2000) *Comput. Biol.* 7:203-214) and redirecting conflicting sequences.

Example 5: DNA Extraction and Library Preparation

We extracted total genomic DNA from leaf tissue of the EMS mutants using the method described by Lagudah et al. (Lagudah et al. (1991) *Genome* 34:375-386). DNA quantification was performed using a NanoDrop spectrophotometer (ThermoFisher Scientific) and the Quant-iT PicoGreen dsDNA assay (Life Technologies). DNA samples were normalized to 3 µg and sheared to an average length of 500 bp in a Covaris S2 Focused-ultrasonicator. A small aliquot was assayed by gel electrophoresis and additional size selection was carried out with Agencourt AMPure XP beads (Beckman Coulter Genomics). Samples were end-repaired followed by 3' dA addition using the NEBNext Ultra DNA Library Prep Kit for Illumina (New England Biolabs). Illumina sequencing adapters were ligated onto the ends and following purification with AMPure XP beads, the DNA was PCR-amplified (6 cycles) using indexed PCR primers (NEBNext Multiplex Oligos for Illumina, New England Biolabs) and the Illumina PE1.0 PCR primer. After purification using AMPure XP beads, quality assays were performed with a Bioanalyzer DNA 1000 chip (Agilent) and the PicoGreen assay to determine the average fragment sizes and concentrations.

Example 6: Target Enrichment and Sequencing of Illumina Libraries

DNA libraries were enriched according to the MYbaits (MYcroarray) protocol and using MYbaits reagents. Briefly, 500 ng of the prepped libraries were hybridized in hybridization buffer (10×SSPE, 10×Denhardt's solution, 10 mM EDTA, 0.2% SDS) to the biotinylated RNA baits for 40 h at 65° C. After hybridization, bound DNA was recovered using magnetic streptavidin-coated beads as follows: the hybridization mix was added to Dynabeads MyOne Streptavidin C1 (Invitrogen, Life Technologies) that had been washed three times and resuspended in binding buffer (1 M NaCl; 10 mM Tris-HCl, pH 7.5; 1 mM EDTA). After 30 min at RT, the beads were pulled down and washed once at RT for 15 min with 1×SSC/0.1% SDS, followed by three 10 minute washes at 65° C. with 0.1×SSC/0.1% SDS. Capture DNA was eluted with 0.1 M NaOH and neutralized with 1 M Tris-HCl, pH 7. Libraries were purified with AMPure XP beads and PCR amplified (14-16 cycles) using Q5 High Fidelity DNA Polymerase (New England Biolabs) and Illumina P5 (5' AATGATACGGCGACCACCGA 3; SEQ ID NO: 58) and P7 primers (5' CAAGCAGAAGACGGCATACGA 3'; SEQ ID NO: 59). The enriched libraries were paired-end sequenced on the Illumina MiSeq or Hi Seq platforms at TGAC (Table 2).

TABLE 2

Libraries Sequenced for Sr22 and Sr45

| Library | Insert size[a] | Enrichment pool | Sequence pool | Sequencing chemistry | Sequence output (Gb) | On target (Gb)[b] |
|---|---|---|---|---|---|---|
| Schomburgk (Sr22) | 500-700 bp | H | 4 | MiSeq (250 bp PE) | 2.9 | 0.9 |
| 1S | 500-700 bp | I | 2 | HiSeq2500 (150 bp PE) | 1.8 | 1.0 |
| 2S | 500-700 bp | I | 2 | HiSeq2500 (150 bp PE) | 2.0 | 1.2 |
| 3S1 | 500-700 bp | J | 5 | HiSeq2500 (150 bp PE) | 2.4 | 1.4 |
| 5S1 | 500-700 bp | J | 5 | HiSeq2500 (150 bp PE) | 3.2 | 1.8 |
| 6S | 500-700 bp | J | 5 | HiSeq2500 (150 bp PE) | 2.8 | 1.7 |
| 7S1 | 500-700 bp | J | 5 | HiSeq2500 (150 bp PE) | 2.9 | 1.7 |
| Schomburgk total RNA | 50-250 | Not enriched | 6 | HiSeq2000 (100 bp PE) | 28.2 | 0.2[c] |
| CS1D5406 (Sr45) | 500-700 bp | K | 7 | MiSeq (300 bp PE) | 3.8 | 0.7 |
| 49S1 | 500-700 bp | L | 7 | HiSeq2500 (150 bp PE) | 4.1 | 0.9 |
| 52S1 | 500-700 bp | L | 7 | HiSeq2500 (150 bp PE) | 4.6 | 1.1 |
| 55S1 | 500-700 bp | L | 7 | HiSeq2500 (150 bp PE) | 4.8 | 1.1 |
| 57S1 | 500-700 bp | L | 7 | HiSeq2500 (150 bp PE) | 5.4 | 1.2 |
| 59S1 | 500-700 bp | L | 7 | HiSeq2500 (150 bp PE) | 6.1 | 1.4 |
| 61S1 | 500-700 bp | L | 7 | HiSeq2500 (150 bp PE) | 5.5 | 1.2 |

[1]Based on Bioanalyzer.
[2]Associated with NB-LRRs.
[3]TopHat mapping on contigs. Only includes reads with source BLAST hit of ≤1E−50.

Example 7: NB-LRR Read Assembly and Comparison

Figure 5:
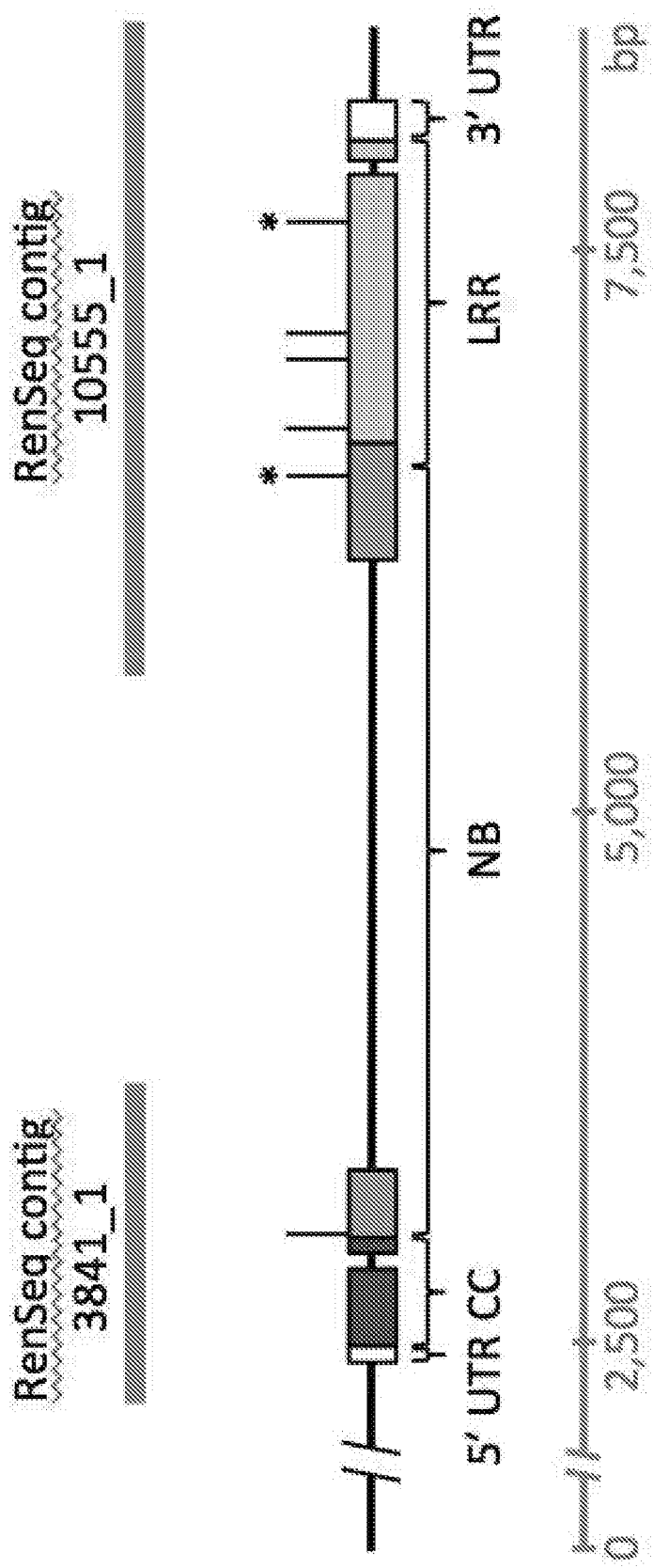
FIG. 5. Cloning of Sr22 by sequencing EMS-induced susceptible mutants. Schematic diagram of Sr22 showing intron-exon boundaries, protein domain structure (coloured boxes), 5' and 3' UTR (white boxes), and location of missense and nonsense (*) mutations. Sr22 and Sr45 contigs obtained by RenSeq are shown in grey. The 3' contig was identified as the best candidate from sequence-comparison of the mutants. The 3' and 5' contigs were bridged by Sr22 RNAseq reads and through BLAST via a full-length NB-LRR in NCBI. The contigs were extended by local RenSeq and genome walking, and the full-length Sr22 sequence was confirmed by PCR amplification and sequencing of a 7.815 kb fragment from genomic DNA.
Figure 6:
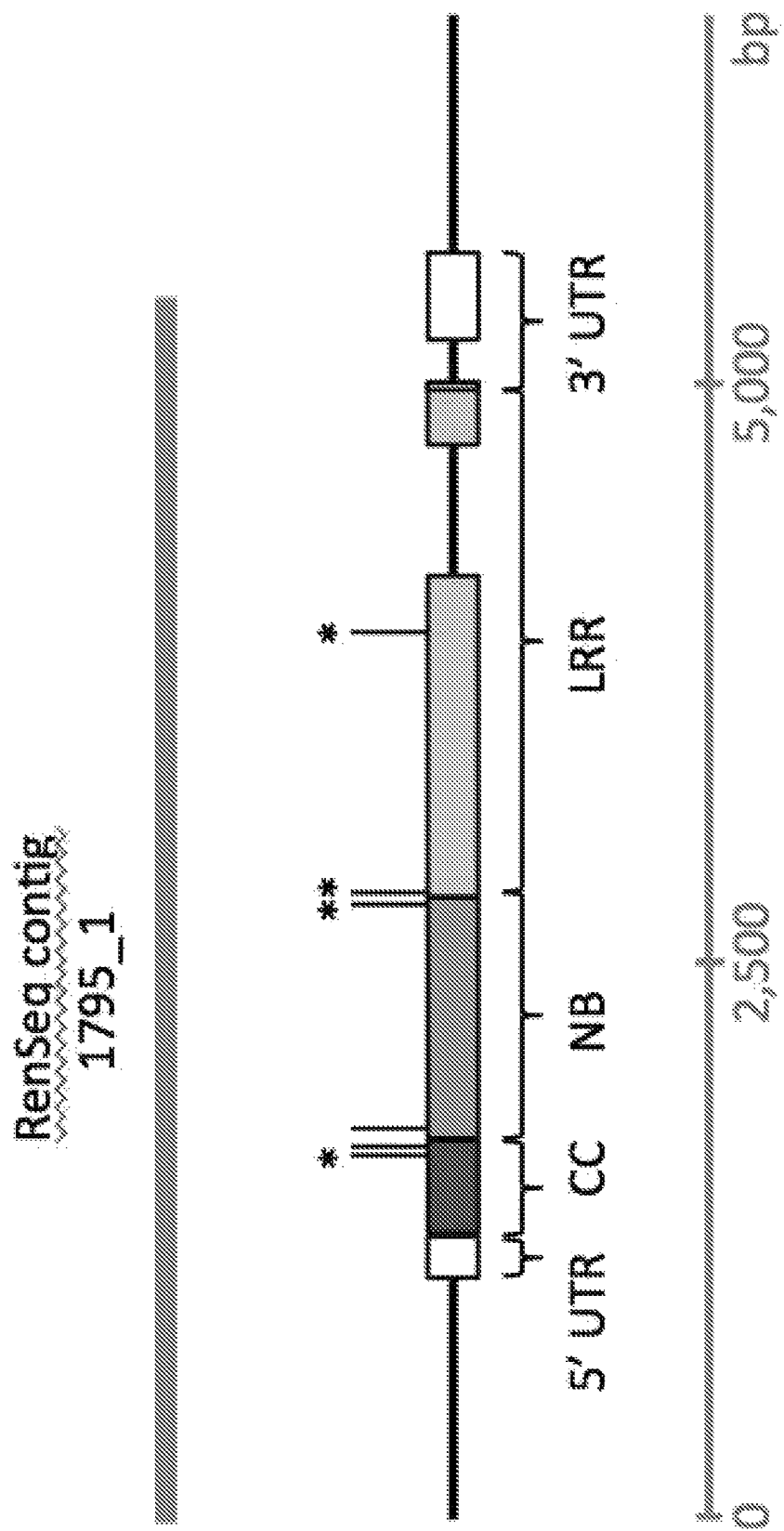
FIG. 6. Cloning of Sr45 by sequencing EMS-induced susceptible mutants. Schematic diagram of Sr45 showing intron-exon boundaries, protein domain structure (coloured boxes), 5' and 3' UTR (white boxes), and location of missense and nonsense (*) mutations. Sr45 contigs obtained by RenSeq are shown in grey. The 3' contig was identified as the best candidate from sequence-comparison of the mutants.

Raw data from wild type was de novo assembled using CLC assembly cell (available on the World Wide Web at: cicbio.com/products/clc-assembly-cell/) and standard parameters. Raw data of each mutant and wild type was aligned to the wild type assembly using BWA (Li and Durbin (2009) *Bioinformatics* 25:1754-1760). The resulting SAM file was filtered for reads mapping as a proper pair using SAMtools (Li et al. (2009) *Bioinformatics* 25:2078-2079) and parameter -f 2. The result was converted to pileup format using SAMtools Mpileup. De novo assembled wild type contigs were aligned to source sequences of the bait library using MegaBLAST (Zhang et al. (2000) *Comput. Biol.* 7:203-214). Only sub-sequences of the contigs having local alignments to the source sequences were considered for further analysis. Using the pileup formats, potentially mutated positions were identified. A position was considered for further analysis if the local coverage derived from the mapping of wild type raw data against wild type assembly was at least 50-fold and the alternative allele frequency of a mutant was at least 10%. The latter step is supposed to be extremely sensitive and bound to identify a large number of false positive positions that are filtered out in a subsequent step. Since it is highly unlikely that two independently mutated plants have the mutation at the same position, every position that was found for more than one mutant was filtered out. Regions with an average coverage less than 10% of the median overall coverage were considered as a deletion mutation for a line. Resulting candidate contigs were ranked by the number of SNP or deletion mutations within subsequences with a local alignment to the bait source sequences. For Sr22, we identified 27 contigs which were mutated in two mutants, and a single 3,408 bp contig which contained independent mutations in five of the mutants (contig_10555_1) (FIG. 5). For Sr45, 28 contigs were identified that contained independent mutations in two or more mutants, but only one 5,266 bp contig had mutations in 6 mutants (contig_1795_1) (FIG. 6).

Example 8: Joining of Sr22 5' and 3' Contigs by BLAST Search, Whole Transcriptome Sequencing, and Long-Range PCR BLAST search (Zhang et al. (2000) *Comput. Biol.* 7:203-214): The Sr22 5' candidate contig (contig_10555_1) was aligned to the NCBI non-redundant protein sequences using BLASTx. The best hit was to the 3' end of a disease resistance gene analogue (RGA) from *Aegilops tauschii* (gi|475585845|gb|EMT20152.1). We then took the 5' end of the RGA that was not covered by contig_10555_1 and searched our Sr22 wildtype assembly using tBLASTn. The best hit, contig_3841_1, covered the remaining 5' part of the Ae. *tauschii* RGA and this contig contained a non-synonymous mutation in the Sr22 mutant 2S. We also confirmed the presence of the mutations by PCR and Sanger sequencing of each mutant. All six mutations are GC to AT transitions that cause nonsense (two) or missense (four) mutations.

RNASeq: Paired-end reads from whole transcriptome sequencing of Sr22 wildtype (Schomburgk) were quality trimmed using Sickle (available on the world-wide web at: github.com/najoshi/sickle). Trimmed reads were aligned to the 3' contig of Sr22 (contig_10555_1) using BLASTn (Zhang et al. (2000) *Comput. Biol.* 7:203-214). All reads with a local alignment (≥99% identity) and their mates were then aligned to the other contigs of the assembly. All contigs were then scored by the number of times they were the best alignment by a read.

For validation of the entire coding sequence of Sr22, transcriptome reads were mapped to the final locus using Tophat2 (Kim et al. (2013) *Genome Biol.* 14:R36). The alignment was manually inspected using Tablet (Milne et al. (2013) *Brief Bioinform.* 14:193-202).

Long Range PCR: The full length sequence of the Sr22 open reading frame was further confirmed by PCR amplification using the Phusion High-Fidelity DNA Polymerase (New England Biolabs Inc.) and the primer pair S22F14 (5' GCGAACTTTACTGTCAACGG 3'; SEQ ID NO: 91) and S22R4 (5' CAAAGATCTCATCGCGACG 3'; SEQ ID NO: 92). PCR products were cloned into the pCR-XL-TOPO vector (Life Technologies) and subsequently sequenced.

Example 9: Local Target Enrichment and Genome Walking

To obtain the promoter and terminator regions of Sr22 we used a modified RenSeq approach, which we called local RenSeq. This approach uses long biotinylated RNA probes (>500 nt) targeting the known 5' and 3' ends of assembled contigs to enrich for long (>2 kb) fragments from genomic DNA libraries. Using this approach we cloned 2.5 kb of promoter (FIG. 5). The genomic DNA library for local RenSeq was constructed essentially as described above for standard RenSeq, with minor modifications. Four µg is of genomic DNA was sheared using gTUBEs with the manufacturer's settings for 5 kb and a library was constructed from 2 µg using NEBNext Ultra DNA Library Prep Kit for Illumina (P5-P7 adaptors) with extended amplification PCR time (5 minutes) to allow amplification of longer DNA fragments. All QC steps were performed as described above for standard RenSeq libraries.

To generate biotinylated RNA probes specific to the 5' of Sr22 we PCR-amplified from Sr22 genomic DNA the first 600 nt corresponding to the 5' candidate contig (contig_10555_1) and cloned it into the pGEM-T Easy Vector (Promega) under T7 promoter. To generate run-off transcripts, the plasmid with the cloned fragment was linearized with PstI (NEB) and biotinylated RNA was synthesized in vitro using the MAXIscript T7 Transcription Kit (Life Technologies) with 60% UTP and 40% Biotin-16-UTP (Cambio). Biotinylated RNA was purified and concentrated using RNA Clean and Concentrator-5 kit (Zymo Research) and quantified with a Nanodrop.

The synthesized biotinylated 5' probe and the long-insert library were mixed in a 1:1 ratio and hybridized as described above for standard RenSeq. To further enrich for promoter sequences, post-enrichment PCR was performed with the Illumina P5 forward primer (SEQ ID NO: 58) and a reverse primer (5' TGCGCTCACCAGAACTTCCGCCAT-TGTTGC 3'; SEQ ID NO: 136) specific to the 5' candidate contig (position 163-192 in contig 3841_1) with the same settings as for library construction. PCR products were run on a 1% agarose gel and fragments of between 2 to 4 kb were excised, purified using Nucleospin Extract Kit (Marchery-Nagel) and cloned into the Zero Blunt PCR Cloning vector (Life Technologies). After transformation we screened 30 bacterial colonies using P5 (SEQ ID NO: 58) and the Sr22 specific primer and obtained six positive colonies. The cloned fragment length varied from 1 to 2.5 kb. The six inserts were Sanger sequenced and all were found to have identical overlapping sequences, with the longest cloned fragment being 2,545 bp. To confirm that the cloned fragment belonged to the Sr22 promoter we PCR amplified a 2.5 kb fragment including 1.6 kb of the newly cloned promoter and 800 bp downstream of the ATG, i.e. encompassing the 2S mutation [using primers KW_sr22_p_seq_F1 (5' CAAGGCTGCTATTGCTGTGTTTGGCCCTGA 3'; SEQ ID NO: 62) and KW_sr22_p_seq_R1(5' GAGCGTGGTCTTGCCCAACCCTCCATAT 3'; SEQ ID NO: 63)]. PCR was performed on genomic DNA from wildtype and the 2S mutant and resulted in a single band, which was directly Sanger sequenced. Sequencing of the wildtype PCR product confirmed the sequence of the putative promoter while the sequence of PCR product from S2 contained the mutation.

Subsequently, the promoter (confirmation of the promoter sequence in case of Sr22) and terminator sequences of Sr22 and Sr45 were also identified by genome walking. For genome walking, the upstream region above the start of the cDNA was amplified using APAgene™ GOLD Genome Walking Kit (Bio SandT Inc., Canada) as per manufacturer's protocol. Primers S22R13 (5' GTTCTTGAGCAGCTTGT-ATTCATCCG 3'; SEQ ID NO: 64), S22R12 (5' CAACAT-AGCTCCCAACTTCCG 3'; SEQ ID NO: 65), and S22R11 (5' ACTTCCGCCATTGTTGCTCTC 3'; SEQ ID NO: 66) designed at the 5' region of the Sr22 gene sequence were used to amplify regions upstream of ATG while S22F35 (5' CTCCTTCTAATTAGATGCATACATTAGAGG 3'; SEQ ID NO: 67), S22F36 (5' GTAGCTCAAACCGTCGGTCC 3'; SEQ ID NO: 68) and S22F37 (5' GATTCGTCGCGAT-GAGATC 3'; SEQ ID NO: 69) primers from 3' region were used to identify the downstream regions. Similarly, the 3' region of Sr45 gene sequence were identified using S45F11 (5' GGCCTAAACTATGGGAACCAAAATCC 3'; SEQ ID NO: 70), S45F12 (5' GGAAATATATGGTTCCTT-CACTGCG 3'; SEQ ID NO: 71) and S45F13(5' GCAAGCGTGAGTCTGAATAGAGG 3'; SEQ ID NO:72) primers.

Example 10: Sr22 and Sr45 5' and 3' RACE

Confirmation of the transcript UTR regions was provided by 5' and 3' RACE. RNA extraction, cDNA synthesis, 5' and 3' RACE (rapid amplification of cDNA ends) were performed following the method described in Krattinger et al. (Krattinger et al. (2009) Science 323:1360-1363). The 5' RACE reaction was performed using primers S22R13 (5' GTTCTTGAGCAGCTTGTATTCATCCG 3'; SEQ ID NO: 64) [for Sr22] and S45G1(5' CAGTGGCCTGACTA-CAAACTCC 3'; SEQ ID NO: 73) [for Sr45] designed at the 5' region while the 3' RACE reaction was performed using S22F13 (5' CCTGCTTTGGGTTGTATCC 3'; SEQ ID NO: 74) [for Sr22] and S45G3 (5' GCTGGATTGCAATAGTAT-TGAGTCC 3'; SEQ ID NO: 75) [for Sr45] primers from the 3' region. To confirm the splice structure, the cDNA were amplified using S22F24 (5' GAGAGAGAGAGAGCAACAATGG 3'; SEQ ID NO: 76) and S22R39 (5' ATAGAATATAGATGCACGCTA-GATCTTT 3'; SEQ ID NO: 77) [for Sr22 from T.boeoticum], S22F24 (5' GAGAGAGAGAGAGCAACAATGG 3'; SEQ ID NO: 76) and S22R37 (5' CTGAATTCGTGA-TACTTGTCTTACTTAT 3'; SEQ ID NO: 78) [for Sr22 from T.monococcum] and S45F7 (5' GCCTAACTCCAGACCAT-TTC 3'; SEQ ID NO:79) and S45R1 (5' AACTTGACTCCCTTGAAGAGG 3'; SEQ ID NO: 80) [for Sr45] primer pairs.

Example 11: Co-Segregation of Sr22 and Sr45 Genes with their Respective Genetic Locus To further validate that we had cloned Sr22 and Sr45, we used the sequence to generate PCR molecular markers and showed complete linkage with the gene locus in the high resolution mapping populations (Schomburgk×Westonia and PI190945×PI272557 populations for Sr22 and CS1D5406×Chinese Spring for Sr45) (FIGS. 3-4). Mapping of the identified Sr22 gene sequence were performed using sequence specific primer pairs [S22F2 (5' CGCAGATG-GATTTCTGAAGGC 3'; SEQ ID NO: 81)/S22R3 (5' ATGTGCCAAATATCATAGTCCG 3'; SEQ ID NO: 82) specific to Sr22 in Schomburgk, S22F2 (SEQ ID NO: 82)/S22R10 (5' CAAATAACGGCTTCTGGG 3'; SEQ ID NO: 83) specific to Sr22 in PI190945, S22F2 (SEQ ID NO: 81)/S22R51 (5' ATGGACTCGGCAATACTCC 3'; SEQ ID NO: 84) specific to the resistance gene analogue of 5r22 (Schomburgk) in Westonia and S22F2 (SEQ ID NO: 81)/S22R22 (5' AAGCTCCGTGATTCCTGTAAG 3'; SEQ ID NO: 85) specific to the resistance gene analogue of Sr22 (Schomburgk) in PI272557]. For mapping Sr45, the primer pair S45F1 (5' AGTACTGTAATAATTGATTCCGTCG 3'; SEQ ID NO: 86)/S45R1 (5' AACTTGACTCCCTT-GAAGAGG 3'; SEQ ID NO: 80) specific to Sr45 gene sequence were used.

Example 12: Sr22 Haplotype Analysis

Figure 7:
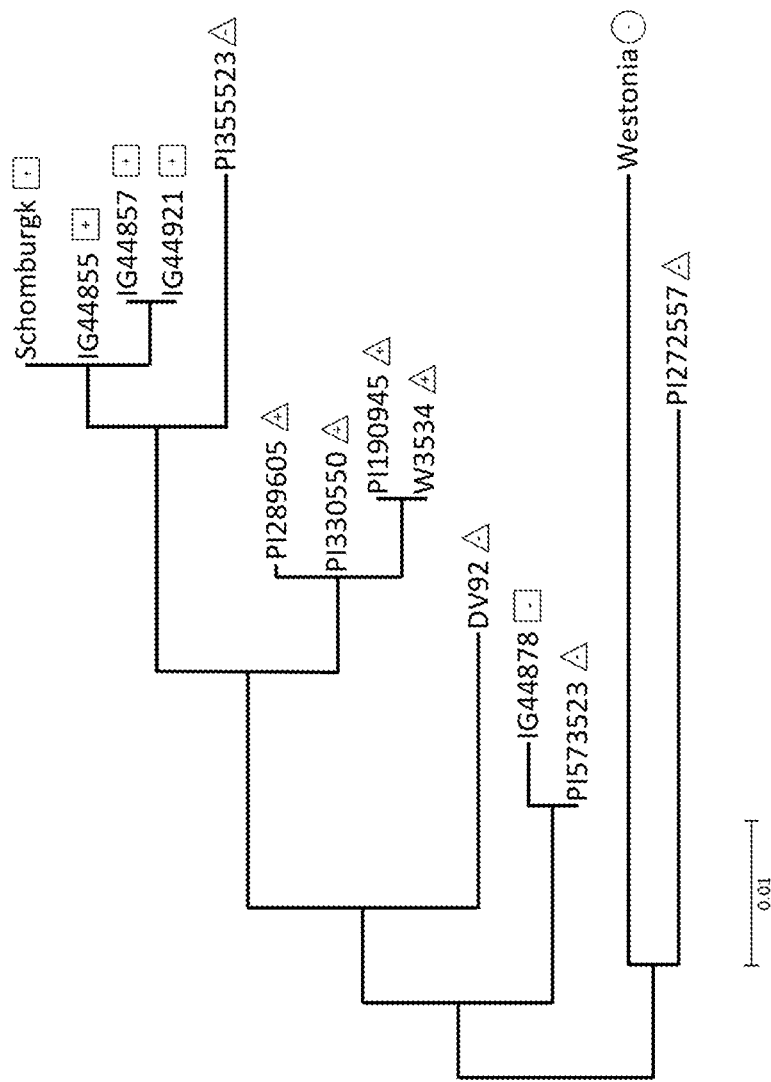
FIG. 7. Neighbor-joining tree analysis of the Sr22 gene variants identified from diploid (A genome) and hexaploid wheat. The postulated presence or absence of Sr22 based on resistance to wheat stem rust is denoted with a "+" or "−" signs, respectively, inside a box, triangle or circle indicating *T. boeoticum*, *T. monococcum* or *T. aestivum* origin, respectively.

In addition to the Sr22 source of T. boeoticum present in Schomburgk, a second source of stem rust resistance from T. monococcum was introgressed to chromosome 7A in other hexaploid wheat backgrounds and was also referred to as Sr22 on the basis of identical specificities to stem rust races. The hexaploid wheat W3534 (Paull et al. (1994) Theor. Appl. Genet. 89:1039-1045) is archetypical of the T. monococcum derived Sr22 and in a subsequent extensive analysis of T. monococcum collections, several accessions including PI190945 were postulated as carriers of Sr22. PI190945 was confirmed to possess a single dominant gene that segregated independently of T. monococcum stem rust resistance genes other than Sr22 (Rouse and Jin (2011) Phytopathology 101:1418-1423). In addition to the four parental lines used to construct the mapping population, variants of the Sr22 gene sequence were identified using 32 T. monococcum accessions, 16 T. boeoticum accessions (from ICARDA), DV92 and W3534 (Paull et al. (1994) Theor. Appl. Genet. 89:1039-1045) described in Table 3. Sr22 related sequences were amplified using two overlapping primer pairs: S22F25 (5' AACAATGGCGGAAGTTCTG 3; SEQ ID NO: 87) and S22R16 (5' ATGTTCTCTTCAGAGGATTTGTCA 3'; SEQ ID NO: 88), and S22F2 (SEQ ID NO: 81) and S22R36 (5' CGTGATACTTGTCTTACTTATTCCTAGTC 3'; SEQ ID NO: 89). For Westonia, the primer pair S22F29 (5' CCGTGCTGTATACCATGTGA 3'; SEQ ID NO: 90) and S22R51 (SEQ ID NO: 84) was used instead of S22F25 and S22R16. We obtained the corresponding Sr22 sequence from PI190945 and it cosegregated with the resistance phenotype located at the same position in the diploid mapping population (PI190945×PI272557) as found in the orthologous location in Schomburgk (FIG. 3). Furthermore W3534 and PI190945 were shown to possess an identical Sr22-like gene sequence. However, they differed from the reference Sr22 gene sequence in Schomburgk with 33 amino acid changes (FIGS. 10A-10P), suggesting allelic variation at the Sr22 locus for these genotypes. Additional sequences from T. monococcum accessions, PI289605 and PI330550 (Table 3) that showed similar responses to Puccinia graminis f. sp. tritici races as PI190945, were identical with each other but differed from PI190945 and W3534 at seven amino acid positions. Similar amino acid changes were also found between the sequences of resistant T. boeoticum accessions (IG44857 and IG44921) and Schomburgk while the sequence from a third T. boeoticum accession, IG44855, was nearly identical to Schomburgk except for a two amino acid deletion at the N terminal region (FIGS. 10A-10P). Unexpectedly, the sequence of T. monococcum accession PI573523 with low rust infection was closely related to the susceptible *T. boeoticum* accession IG44878 indicating the possibility of resistance from a locus other than Sr22. Overall, a number of amino acids were found to provide distinctions between the diploid A genome taxa, however, the sequence of one stem rust susceptible accession from *T. monococcum* grouped with the *T. boeoticum* resistant genotypes indicating the possibility of an intermediate taxa or a misclassification (FIG. 7).

TABLE 3

Diploid Accessions (A genome) and Hexaploid Wheats Used to Identify Sr22 Variants

| Species | Accession | Rust Response |
|---|---|---|
| *T. monococcum** | PI190945 | ;1− |
| | PI353504 | 2 |
| | PI352505 | 2 |
| | PI554517 | 2 |
| | PI554567 | 2 |
| | PI573520 | 2 |
| | PI352486 | 2 |
| | PI355517 | 2 |
| | PI355522 | 22− |
| | PI355524 | 22− |
| | PI362553 | 2 |
| | PI362554 | 2 |
| | PI289605 | 2 |
| | PI330550 | 2 |
| | PI573523 | 2 |
| | PI306527 | 3+ |
| | PI352274 | 3+ |
| | PI401411 | 3+ |
| | PI427461 | 3+ |
| | PI554507 | 3+ |
| | PI554519 | 3+ |
| | PI277140 | 3+ |
| | PI306542 | 3+ |
| | PI352475 | 3+ |
| | PI355526 | 3+ |
| | PI355528 | 3+ |
| | PI355537 | 3+ |
| | PI355543 | 3+ |
| | PI542473 | 3+ |
| | PI272557 | 3+ |
| | PI355523 | 3+ |
| | DV92 | 3+ |
| *T. boeoticum*# | IG44855 | 2= |
| | IG44856 | 2= |
| | IG44857 | 2= |
| | IG44866 | 2= |
| | IG44868 | 2= |
| | IG44870 | 2= |
| | IG44887 | 2= |
| | IG44895 | 2= |
| | IG44919 | 2= |
| | IG44921 | 2= |
| | IG44811 | 3+ |
| | IG44813 | 3+ |
| | IG44833 | 3+ |
| | IG44847 | 3+ |
| | IG44878 | 3+ |
| | IG44890 | 3+ |
| *T. aestivum*# | Schomburgk | 2− |
| | W3534 | 22− |
| | Westonia | 3+ |

*infection score against North American stem rust race QFCSC (reproduced from Rouse and Jin 2011, *Phytopathology* 101: 1418-1423, *Plant Dis.* 95: 941-944).
infection score against the Australian stem rust race 17-1,2,3,7 = 142

Example 13: Creation of Sr22 and Sr45 Constructs

A genomic fragment, 7.815 kb, was isolated from wheat (*Triticum aestivum*) cv Schomburgk, which carries the Sr22 stem rust resistance gene introgressed from *Triticum boeticum*. The fragment was amplified using the primers S22F14 (5'GCGAACTTTACTGTCAACGG 3'; SEQ ID NO: 91) plus S22R4 (5'CAAAGATCTCATCGCGACG 3; SEQ ID NO: 92) and the Phusion High-Fidelity DNA Polymerase (New England Biolabs Inc.) under the manufacturer's recommended conditions. Similarly, the corresponding Sr22 sequence from the *T. monococcum* accession PI190945 was also amplified using S22F43 (5' CAATTTCATCAAGACATGCG 3'; SEQ ID NO: 93) and S22R24 (5' GATGTTATTTAATTATGGTTTGGCC 3'; SEQ ID NO: 94) primers. For Sr45, a 6.8 kb genomic fragment containing Sr45 was amplified from *Aegilops tauschii* accession AUS18911, using S45F1 (5'AGTACTGTAATAATTGATTCCGTCG3'; SEQ ID NO: 86) and S45R5 (5'GAAATTCCTGCTGCATTGC3'; SEQ ID NO: 137) primers. The Sr22 genomic fragment was cloned into the NotI site of the binary vector pVecBARII (SEQ ID NO: 163), a derivative of pWBvec8 (Wang et al. (1998) *Acta Hortic.* 461:401-405) in which the 35S hygromycin gene has been replaced with a 35S NPTII selectable marker gene derived from pCMneoSTL2 (Maas et al. (1997) *Mol. Breed.* 3:15-28)

Generation of Sr22 and Sr45 Binary Constructs Through GoldenGate Cloning

1. Sr22 and Sr45 Components Design

For Sr22, three promoters including the maize ubiquitin, the Sr33 promoter region, and the Sr22-PI190945 promoter region were used for the designs. Sr22 coding regions (sequence from start to stop codon, including both exons and introns), from three different sources, including Sr22-Schomburgk, PI190945, and PI573523 were used for the designs. For the simplicity of the construct synthesis, the coding regions were divided into two sections, namely coding region 1 and 2. Three terminator regions including Sr22-Schomburgk, Sr22-PI190945, and Sr33 terminators were used for the designs.

For Sr45, the Sr45 coding region was used for the design.

For GoldenGate cloning the BsaI restriction endonuclease was chosen. Therefore, all the BsaI sites were domesticated (i.e. removed by editing prior to DNA synthesis) without changing the predicted amino acid coding sequence within the exons of the coding regions, and without changing the intron splice donor/acceptor sites. In the case of Sr45, we also removed a single BpiI site without changing the predicted amino acid coding sequence. The domestication for BsaI (and BpiI, in the case of Sr45) sites was performed using the program Geneious 7.1.7. The sequence AATG was added to link promoter and coding regions and GCTT to link coding regions and terminators. The sequence ACGT was added to link coding region 1 and 2. GGAG and CGCT were added to link the left and right borders of the vector.

In total 11 constructs were designed, nine for Sr22 and one three for Sr45 (Table 4).

In addition, one whole synthetic gene, which was not domesticated for BsaI sites, and composed of the Sr33 promoter fused to the Sr22 coding region fused to the Sr33 terminator was designed and synthesised.

To facilitate the transfer of the synthetic genes into the binary vector vecBAR II, a NotI site was introduced at the start of the promotor and at the end of the terminators.

2. Construct Synthesis

All these toolkit constructs were synthesised by a commercial DNA synthesis provider. The Sr22 toolkit sequences were received in the vector PUC57 while the Sr45 construct was received in the vector pMS.

3. Plasmid Rescue of Toolkit Constructs The plasmids containing toolkit sequences were diluted 100-fold and transformed into SUBCLONING EFF DH5 COMPETENT CELLS from Life Technology Ltd following the manufacturer's protocol. 50 µl of 10-fold diluted transformed DH5 was spread on plates with antibiotic selection. Single colonies were picked into 10 ml LB media in 50 ml conical tubes and cultured overnight. The plasmids were extracted with NucleoSpin Plasmid (Macherery-Nagel) following the manufacturer's protocol.

4. GoldenGate Cloning

A total of three synthetic genes (promoter, coding region, and terminator combinations) for Sr22-Schomburgk, two for Sr22-P1190945, two for Sr22-PI573523 and three for Sr45 will be generated (Table 4) through GoldenGate cloning according to the protocol below:

a. 100 ng of acceptor plasmid-pICH47732 will be used for each reaction.

b. Plasmids containing each part to be inserted will be tested for concentration. A 2:1 molar ratio of insert:acceptor plasmids will be used for all promoter-coding region-terminator combinations.

c. 2.0 µl T4 ligase buffer (10×, NEB), 2 µl Bovine Serum Albumin (10×), and 0.5 µl of 400 U/µl T4 DNA ligase (200 units, NEB), and 0.5 µl of 10 U/µl BsaI (5 units, NEB) will be used for each reaction. The reaction schedule will be:
37° C., 20 seconds
Then 26 cycles as follows:

| | |
|---|---|
| 37° C. | 3 min |
| 16° C. | 4 min |
| Then, | |
| 50° C. | 5 min |
| 80° C. | 5 min |
| 10° C. | store. |

5 µl of reaction will be used for transformation into DH5 COMPETENT CELLS of Life Technology Ltd. according to the manufacturer's protocol. 50-100 µl of transformed DH5 will be spread onto a plate containing Carbinicillin (50 mg/ml), IPTG (0.1 mM), X-Gal (20 ug/ml). White colonies will be cultured in LB media containing Carbinicillin (50 mg/ml). 5 ml of the culture will be pelleted and the plasmids will be extracted with NucleoSpin Plasmid (Macherey-Nagel) following the company's protocol.

TABLE 4

Promoter-coding region-terminator combinations for eight Sr22 and three Sr45 synthetic genes

| Synthetic gene | Promoter | Coding region[1] | Terminator region |
|---|---|---|---|
| Sr22-1 | Maize ubiquitin (SEQ ID NO: 138) | Sr22 Schomburgk (SEQ ID NO: 141 or 142) | Sr22 Schomburgk (SEQ ID NO: 148) |
| Sr22-2 | Sr33 (SEQ ID NO: 139) | Sr22 Schomburgk (SEQ ID NO: 141 or 142) | Sr33 (SEQ ID NO: 147) |
| Sr22-3 | Sr33 (SEQ ID NO: 139) | Sr22 Schomburgk (SEQ ID NO: 141 or 142) | Sr22 Schomburgk (SEQ ID NO: 148) |
| Sr22-4 | Maize ubiquitin (SEQ ID NO: 138) | Sr22 PI190945 (SEQ ID NO: 143 or 144) | Sr22 PI190945 (SEQ ID NO: 149) |
| Sr22-5 | Sr33 (SEQ ID NO: 139) | Sr22 PI190945 (SEQ ID NO: 143 or 144) | Sr33 (SEQ ID NO: 147) |
| Sr22-6 | PI190945 (SEQ ID NO: 140) | Sr22 PI190945 (SEQ ID NO: 143 or 144) | Sr22 PI190945 (SEQ ID NO: 149) |
| Sr22-7 | Maize ubiquitin (SEQ ID NO: 138) | Sr22 PI573523 (SEQ ID NO: 145 or 146) | Sr22 Schomburgk (SEQ ID NO: 148) |
| Sr22-8 | Sr33 (SEQ ID NO: 139) | Sr22 PI573523 (SEQ ID NO: 145 or 146) | Sr33 (SEQ ID NO: 147) |
| Sr45-1 | Maize ubiquitin (SEQ ID NO: 139) | Sr45 (SEQ ID NO: 150) | Sr33 (SEQ ID NO: 147) |
| Sr45-2 | Sr33 (SEQ ID NO: 139) | Sr45 (SEQ ID NO: 150) | Sr33 (SEQ ID NO: 147) |
| Sr45-3 | PI190945 (SEQ ID NO: 140) | Sr45 (SEQ ID NO: 150) | Sr22 PI190945 (SEQ ID NO: 149) |

[1]Separate Sr22 synthetic genes were prepared for each of the coding regions listed in Table 4. For example, a first Sr22-1 synthetic gene was constructed using the Sr22 Schomburgk coding region set forth in SEQ ID NO: 141 and a second Sr22-1 synthetic gene was constructed using the Sr22 Schomburgk coding region set forth in SEQ ID NO: 142.

A total of 41 primers were designed using the program Primers 3 for checking the sequences of the synthetic Sr22 and Sr45 genes from the GoldenGate cloning (Table 5).

TABLE 5

Sequences for 41 primers

| Name | Sequence | SEQ ID NO | Note |
|---|---|---|---|
| PMUP-1 | AATGCCAGCCTGTTAAACGC | 95 | |
| PMUP-2 | TGTGTTAGATCCGTGCTGCT | 96 | |
| PMUP-3 | ATGATGTGGTGTGGTTGGGC | 97 | |
| PSR33P-1 | CTTGAGTGCTGTTGGTCTTCC | 98 | |
| PSR33P-2 | GGCAACTCTGTTCTATAGCTCGT | 99 | |
| PSR33P-3 | CTTCCACATCCCCACCTTCC | 100 | |
| PSR33P-4 | TGCCTTGAACAGATCCATCCA | 101 | |

TABLE 5-continued Sequences for 41 primers

| Name | Sequence | SEQ ID NO | Note |
|---|---|---|---|
| PPI190945P-1 | CTGAGCATGGAGTAGCAGCA | 102 | |
| PPI190945P-2 | GAATGGGTCGTTACGTTGCG | 103 | |
| CRSR22P-1 | ATGGCGGAAGTTCTGGTGAG | 104 | |
| CRSR22P-2A | TTGACGACTCCTCCTCCTCT | 105 | For Schomburgk |
| CRSR22P-2B | TTGACGAgTCCTCCTCCTCT | 106 | For PI190945 and for PI573523 |
| CRSR22P-3A | CTCATGCATAATCGGTTGCCT | 107 | For Schomburgk and PI573523 |
| CRSR22P-3B | CTCATGCATAATCcGTTGCCT | 108 | For PI190945 |
| CRSR22P-4 | AGATCGGACCAGCCTGACTA | 109 | |
| CRSR22P-5 | AAGCCCGTCAAAGTCCACAT | 110 | |
| CRSR22P-6 | TCCATCACGCACAGCCAAAT | 111 | |
| CRSR22P-7 | CGGGATGTACTGGTGGTCC | 112 | |
| CRSR22P-8 | CGTTGGCGTGTTAGAGTTGC | 113 | |
| CRSR22P-9 | GGCTGTGAAGAAAGCTGTCC | 114 | |
| CRSR22P-10 | ATAGGGTATGACGGCAAGGC | 115 | |
| CRSR22P-11A | AGGTGGGTTGGGAAACTTGA | 116 | For Schomburgk and PI190945 |
| CRSR22P-11B | AGaTGGGTTGGGAAACTTGA | 117 | For PI573523 |
| CRSR22P-12A | ACAGTTGCAGAAGTTTGAGGC | 118 | For Schomburgk |
| CRSR22P-12B | ACAGTTGCAGAgGTTTGAGct | 119 | For PI190945 and PI573523 |
| TSR33P-1 | TGCTTCAGGTGTGCTCTCAA | 120 | |
| TSR33P-2 | GCTAGTGGCGTCTGAGATGT | 121 | |
| TSR33P-3 | AGTTTGGTGTCATTGGGTTTTCG | 122 | |
| TSchomburgkP-1 | CGAGATGCGCCTTTGGTTATG | 123 | |
| TSchomburgkP-2 | CGTCGCGATGAGATCTTTGA | 124 | |
| TSchomburgkP-3 | ACAACTTCATCCACCCGAATCA | 125 | |
| TPI190945P-1 | CGAGATGCGCCTTTGGTTATG | 126 | |
| TPI190945P-2 | TGGCGGTCAAAGATGCGTAT | 127 | |
| CRSR45P-1 | TGGATGGCATGAAGGAGCAG | 128 | |
| CRSR45P-2 | TGATCAAGCTGGCGATAGGG | 129 | |
| CRSR45P-3 | ATGGACAGATGTGGAGGCTC | 130 | |
| CRSR45P-4 | CTGTCCACTGGTCCTACACG | 131 | |
| CRSR45P-5 | GCTCTAGTCCTGGTTGCAGT | 132 | |
| CRSR45P-6 | TTTGAGAGATGGGTGGCAAC | 133 | |
| CRSR45P-7 | AAAGGATGCCGTACCCGTAC | 134 | |
| CRSR45P-8 | GACATCTCCAACAGCGGCTT | 135 | |

5. Transferring Synthetic Genes into the Binary Vector vecBAR II

Vector vecBAR II was recovered through the same protocol used above (point 3). The vecBAR II plasmid was digested with NotI and then dephosphorylated with Antarctic Phosphatase (NEB) following the company's protocol.

Plasmids containing synthetic Sr22 and Sr45 genes from the GoldenGate cloning will be digested with NotI following the company's protocol. The digested plasmids will be run out in an agarose gel and the insert bands will be cut out and purified with the QIAquick Gel purification Kit following the company's protocol. Then, the Sr22 and Sr45 synthetic genes (inserts) and the dephosphorylated vecBAR II will be ligated using DNA T4 ligase following the company's protocol. 5 μl of the ligation reaction will be taken for transformation into DH5 COMPETENT CELLS of Life Technology Ltd. 50-100 μl of transformed DH5 will be spread on a plate containing Spectinomycin (50 mg/ml). Single white colonies will be cultured in LB media containing Spectinomycin (50 mg/ml). 5 ml of the culture will be pelleted and the plasmids will be extracted with NucleoSpin Plasmid (Machery-Nagel) following the company's protocol. Binary plasmids containing the desired insert will be transformed into *Agrobacterium tumefaciens* for wheat transformation.

Example 14: Transformation of Wheat with Sr22 and Sr45

*Agrobacterium* transformation of wheat was undertaken as described by Ishida et al. (2014) "Wheat (*Triticum aestivum* L.) Transformation Using Immature Embryos," in "*Agrobacterium* Protocols: Volume 1," *Methods in Molecular Biology* 1223:199-209. Wheat cultivar, Fielder, plants were propagated under glasshouse growth conditions using a 24° C., 16 h light/18° C., 8 h dark growth regime and plants were fertilised fortnightly with Aquasol. Wheat heads were tagged at anthesis and harvested 12-14 days post anthesis for transformation experiments as described by Ishida et al (2014) and adopted at CSIRO, Canberra, Australia (Richardson et al. (2014) *Plant Cell Tiss. Organ Cult.* 119:647-659). Briefly seeds were surface sterilised for 10 min in a 0.8% sodium hypochlorite solution. Embryos were removed from the seed under aseptic conditions and co-cultivated with *Agrobacterium* strains containing the Sr22 and Sr45 genomic fragment binary construct for 2 days on WLS-AS medium (Ishida et al. (2014) "Wheat (*Triticum aestivum* L.) Transformation Using Immature Embryos," in "*Agrobacterium* Protocols: Volume 1," *Methods in Molecular Biology* 1223:199-209) in the dark. After co-cultivation embryonic axes were excised with a scalpel and explants were then transferred to WLS-Res medium and placed in the dark at 24° C. After 5 days explants were transferred to WLS-P5 callus induction media containing 5 mg/ml of phosphinothricin (PPT) for callus formation.

Two weeks later, the resulting calli are bisected and are placed on WLS-P10 (10 mg/l of PPT) for 3 weeks in the dark. Callus is then regenerated on LSZ-P5 (5 mg/l PPT) medium in 200 μmols $m^{-2}$ $s^{-1}$ light at 24° C. Shoots are transferred to LSF-P5 (5 mg/l PPT) medium to allow root formation and once robust root systems are developed, plants are transferred to the glasshouse.

Example 15: Scoring of Sr22 and Sr45 Transformants for Resistance to Stem Rust

To score the presence of Sr22 and Sr45 mediated resistance, transgenic lines from the T0 and T1 generation are infected with the stem rust resistance race 98-1,2,3,5 and 6. Two weeks post inoculation, plants are assessed of resistance. Plants with a resistant to moderately resistant infection type are characterized by small to medium sized uredia with green islands surrounded by chlorosis. The resistant and moderately resistant infection types are expected to cosegregate with the transgene in the transgenic plants. In contrast, plants with high infection types are characterized by large uredia and no chlorosis. The high infection types are not expected to cosegregate with the Sr22 or Sr45 transgene in the transgenic plants.

Example 16: Verification of Sr22 and Sr45 Mediated Resistance in Transgenic Wheat Separate constructs comprising Sr22 from Schomburgk, Sr22 from PI190945, Sr22 from PI573523 or Sr45, with native or non-native regulatory elements (Table 6) were cloned into the NotI site of the pVecBARII binary vector and then transferred into *Agrobacterium* for transformation of wheat cultivar Fielder essentially as described in Example 14. Transgenic wheat lines were screened for resistance to Australian stem rust race 98-1,2,3,5 and 6 essentially as described in Example 15, and the results are shown in FIGS. 11A-11E.

The results for the susceptible cultivar Fielder transformed with construct PC103 comprising Sr22 from Schomburgk (*T. boeoticum*) with the native Sr22 5' and 3' regulatory elements are shown in FIG. 11A. The figure shows six transgenic plants (numbered PC103-1, -2, -3, -4, -5, -6). All were found to be resistant to the Australian stem rust race 98-1,2,3,5 and 6, similar to the Sr22 response in cultivar Schomburgk (infection type 2-).

The results for the susceptible cultivar Fielder transformed with construct PC129 comprising Sr22 from PI190945 (*T. monococcum*) with the native 5' and 3' regulatory elements are shown in FIG. 11B. A total of 13 transgenic plants were recovered and scored for resistance to the Australian stem rust race 98-1,2,3,5 and 6. Plant numbers PC129-1, -4, -6, -7, -8, -10, -11, -13 had a resistance similar to the Sr22 response in PI190945 (infection type 2-). Of these eight plants, PC129-1, -4, -6, -11, and -13 are shown in the image. One plant (PC129-9) had an infection type of 2 (slightly higher than PI190945), while three plants (PC129-2, -5 and -12) had an infection type of 2+(higher than PI190945). One plant (PC129-3) had an infection type of 3+, which is similar to Fielder.

The results for the susceptible cultivar Fielder transformed with construct PC110 comprising Sr45 from *Aegilops tauschii* accession AUS18911 with the native 5' and 3' regulatory elements are shown in FIG. 11C. A total of 12 transgenic plants were recovered and scored for resistance to the Australian stem rust race 98-1,2,3,5 and 6. Seven plants (PC110-1, -2, -4, -5, -7, -10, -12) had an infection

TABLE 6

Description of Constructs Used for Producing Transformed Plants and Phenotypes of the Transformants

| Construct | JIC Construct Designation | CSIRO Construct Designation | Promoter | Coding region | Terminator | Domestication[1] | Phenotype[2] |
|---|---|---|---|---|---|---|---|
| Sr22-Scho (SEQ ID NO: 160) | — | PC103 | Sr22 Schomburgk | Sr22_Schomburgk | Sr22_Schomburgk | Native | 6/6 R |
| Sr22-118 (SEQ ID NO: 157) | pBW0006 | PC132 | Sr33 | Sr22_Schomburgk | Sr33 | Native | 10/10 R |
| Sr22-1 (SEQ ID NO: 152) | pBW0001 | PC126 | Maize ubiquitin | Sr22_Schomburgk | Sr22_Schomburgk | P-BpiI, BsaI C-BsaI T-BsaI | 10/10 R |
| Sr22-2 (SEQ ID NO: 153) | pBW0002 | PC127 | Sr33 | Sr22_Schomburgk | Sr33 | P-Native C-BsaI T-Native | 10/10 R |
| Sr22-3 (SEQ ID NO: 154) | pBW0003 | PC128 | Sr33 | Sr22_Schomburgk | Sr22_Schomburgk | P-Native C-BsaI T-BsaI | 10/10 R |
| Sr22-mono (SEQ ID NO: 161) | — | PC129 | Sr22 PI190945 | Sr22_PI190945 | Sr22_PI190945 | Native | 12/13 R |
| Sr22-5 (SEQ ID NO: 155) | pBW0004 | PC130 | Sr33 | Sr22_PI190945 | Sr33 | P-Native C-BsaI T-Native | 10/10 R |
| Sr22-7 (SEQ ID NO: 156) | pBW0005 | PC131 | Maize ubiquitin | Sr22_PI573523 | Sr22_Schomburgk | P-BpiI, BsaI C-BsaI, T-BsaI | 10/10 S |
| Sr22-8 (SEQ ID NO: 158) | pBW0007 | PC146 | Sr33 | Sr22_PI573523 | Sr33 | P-Native C-BsaI T-Native | 10/10 S |
| Sr45 (SEQ ID NO: 162) | — | PC110 | Sr45 | Sr45 | Sr45 | Native | 11/12 R |
| Sr45-2 (SEQ ID NO: 159) | pBW0008 | PC147 | Sr33 | Sr45 | Sr33 | P-Native C-BpiI, BsaI T-Native | 9/10 R |

[1]Restriction endonuclease sites removed from the promoter (P), coding (C), and terminator (T) regions by domestication are listed. Native denotes that no sites were domesticated.

[2]R = resistant, S = susceptible.

type; 1 which is similar to Sr45 in AUS18911 and CS1D5406. Four plants (PC110-3, -6, -9, -11) had an infection type 1 (slightly higher than AUS18911). One plant (PC110-8) had an infection type of 3+ which is similar to Fielder.

Figure 11A:
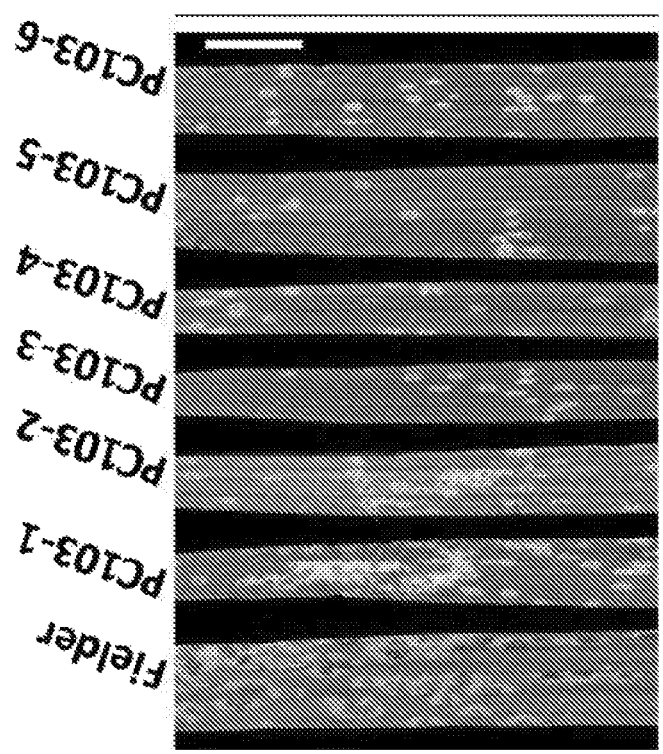
FIGS. 11A-11E are collectively a multipanel figure showing results from stem rust resistance tests of Fielder transformed with Sr22 from Schomburgk, Sr22 from PI190945 and Sr45. In each of FIGS. 11A-11E, the white scale bar is equivalent to 10 mm
Figure 11B:
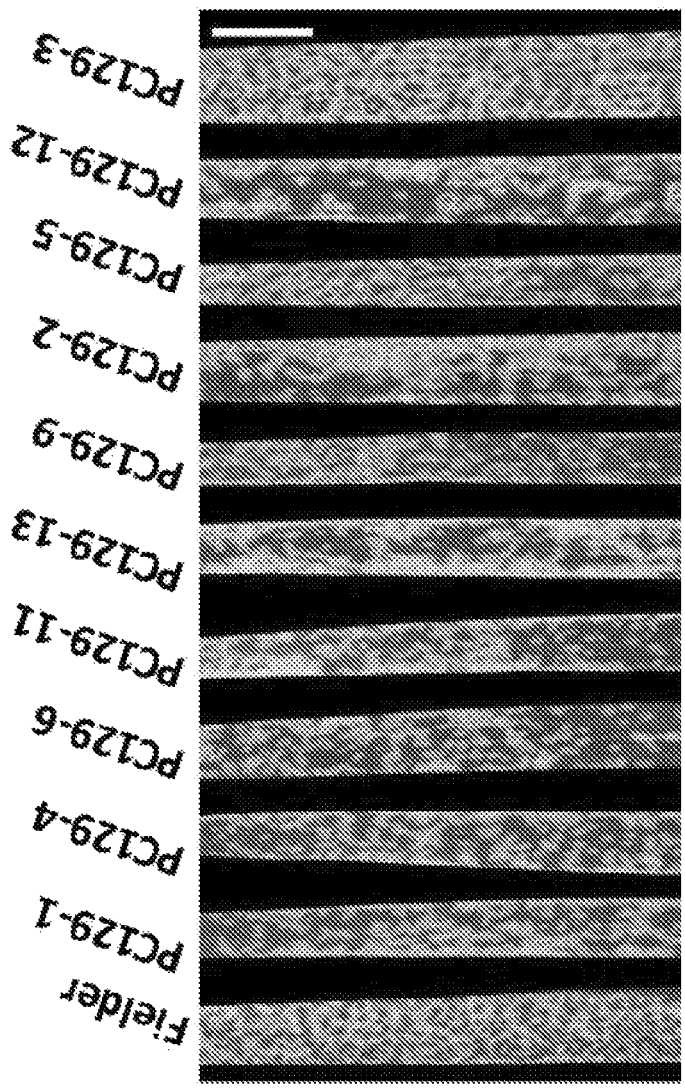
Figure 11C:
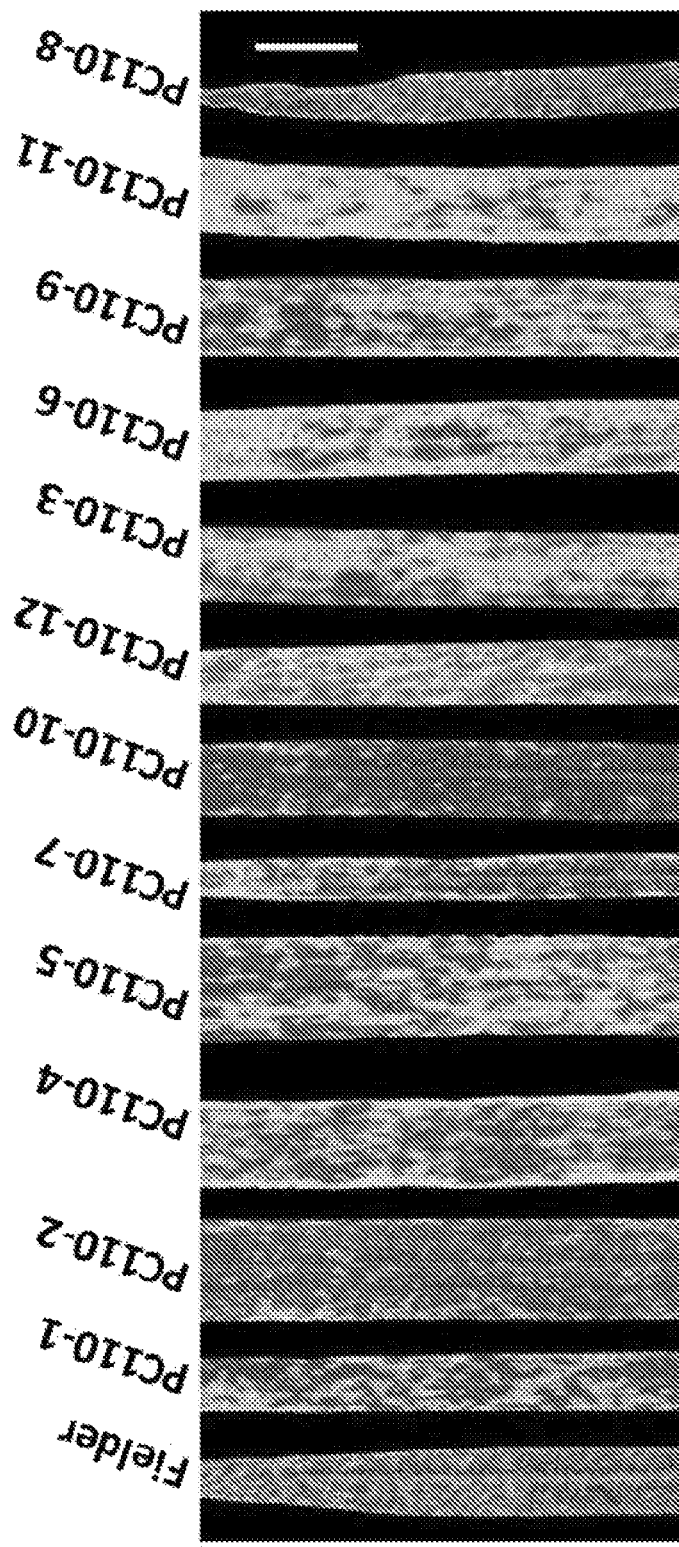
Figure 11D:
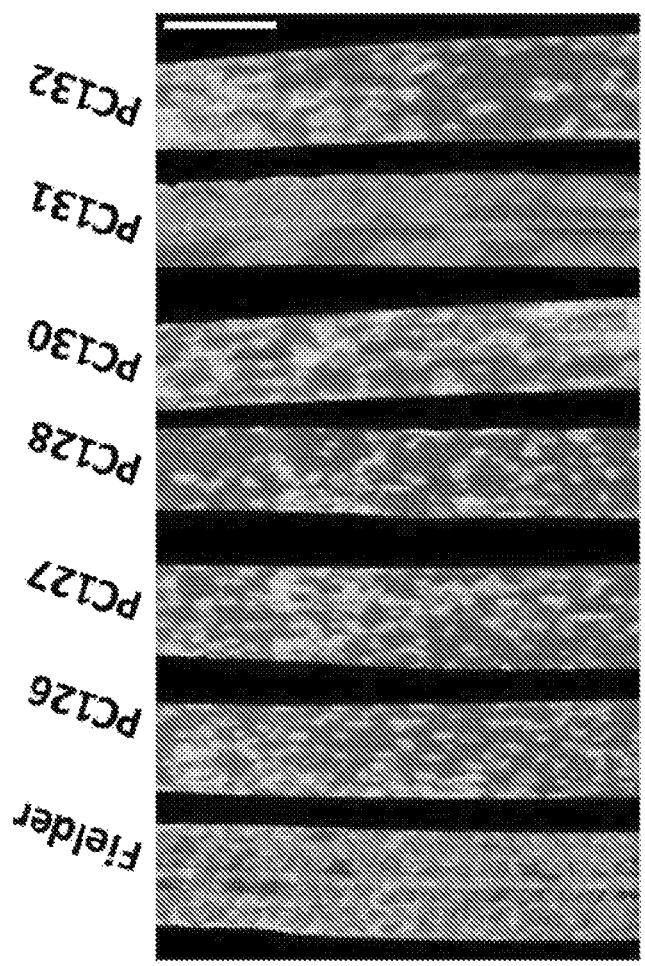
Figure 11E:
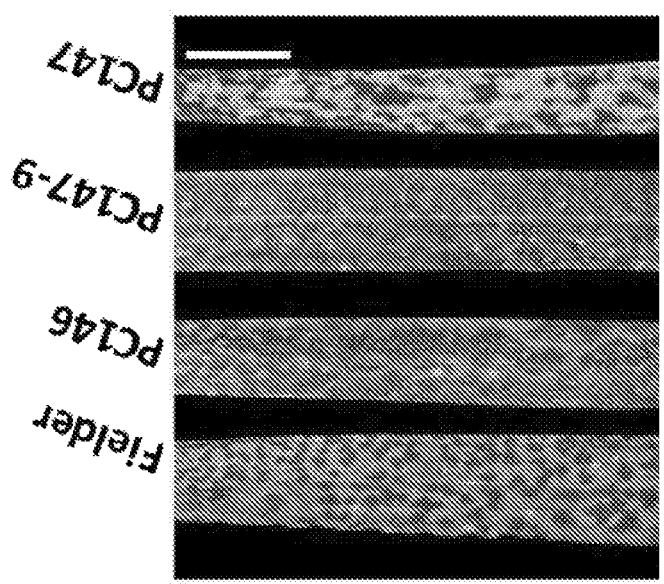

The results from transgenic plants comprising Sr22 from Schomburgk, Sr22 from PI190945 and Sr22 from PI573523 with native or non-native regulatory elements are shown in FIGS. 11D-11E. The susceptible cultivar Fielder was transformed with the constructs PC126, PC127, PC128, PC130, PC131, PC132, PC146 and PC147. The promoter, coding region, and terminator for each construct is set forth in Table 6. For each construct ten transgenic plants were scored for resistance to the Australian stem rust race 98-1,2,3,5 and 6. In FIG. 11D, the plants derived from PC126, PC127, PC128, PC130, and PC132 were all resistant with infection types ranging from 1+ to 2, while the plants derived from PC131 were all susceptible with infection types of 3+. A representative plant for each construct is shown in the picture. In FIG. 11E, all plants derived from PC146 were highly susceptible, while the plants derived from PC147 (except line 9) produced infection type; 1 typical of the strong resistance reaction of Sr45.

The article "a" and "an" are used herein to refer to one or more than one (i.e., to at least one) of the grammatical object of the article. By way of example, "an element" means one or more element.

Throughout the specification the word "comprising," or variations such as "comprises" or "comprising," will be understood to imply the inclusion of a stated element, integer or step, or group of elements, integers or steps, but not the exclusion of any other element, integer or step, or group of elements, integers or steps.

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (163 sequences)

SEQ ID NO: 1 - DNA, 9859 bp, Triticum aestivum
ccgcccagcaacgccgcccctgtccccgggcgcccgccgccgccgggaagcaaactagttcccgccgccgcttcccccaccgcacagccgcccgcgaccaagaagacgcctcgccacccccgccacatacgaccgacacgctcgtcggacgccgtcacactcgtcggacgcaggcagggcagctagttggtctgtgggcgccgcgtctcccctcaccggccgtctccttcttctacgcccgcaagctgttcgacagtttgccaaggtacgaaaatgaactccgccgatgagtgttttttccacaatttcatttgcgactccgacgattcgtcgtccgacgacgaggaggagatattggctgccatgttggtccatcaccacctcaacagccagcggccgttgttccgtggctccataccgggccaccttcccgacgttgaaccgcaatcgagagagcgggcatttccttcttcggaaggactactttgatacaacaaacccgttgttcaaacatcaaaaattccgtcgtcgtttccgtatgagtaggcatcttttcaaccgtattagagagggggtggtcggctatgatgactattgcgagtgaaagaggatgccgtcggcaagatcggtttctcctcttatcagaaatgcactgccgccatccgaatgcttgcatacggagtgcacggtgatctcattgacgagtacgtccgtatgagtgagtctacatgcctagagtccctgtataagttctgcaaggctgctattgctgtgtttggccctgagtacttgagaaagccgacaactaaagatacatcttgtttgttggcgacgaatgccagaaggggctttccagggatgcttggcagcatagactgcatgcactgggagtggaagaactgtccttctgcttggcaagggcaatataagggacatgtcagggcttgcgctgtcatactaaggccgtgacatctcaagatctctggatctggcactctttctttggcatggctggatcacacaatgatatcaacgtgcttcagcgctcgcgggtgtttgctaggcttgccgaaggcaacagcccaccggcgaactttactgtcaacggacacaactacgacaaacgatactacctgggtgatagtatctatcctagtggaccactattgtcaagataatacccaaccctgtcggagagaagaggaaaagatttgcccatgagcaagagagtgctaggaaggatgtcgagcgtgcctttggtgttttgcaatctcgatggggcatcgttcggtatgctgctaatatctggagcacgcagaaactgtgggaggtgatgactgcttgtgtgatcatgcataatatgatcgtagaagacgagcgaccggaacgtctgtacgatcaagggtttcagtttcagagtgagaatgttgtgcctgagcatggagtagcagcaacgtttgaacagttcatccaatttcatcaagacatgcgtgattgggaaactcacgtgcagccgcaaaatgatttggttgagtatatgtggggtcatgttggcaaccaatagatatatcttcttttattcgtttgcaaaactatgaaacatttatttttatttttatttgtatccggcttgtaaaactatactattttatttggtaaactatgttatttgacaatatgtttgaatgcaaatcaatataatattgggcggccagccagccacgccgacacgtataggtcgacgcgttgggcgcgctgccgactcaaatctaaaaaagggcggacgccgggcgggcgggcgacccaaacgaacaaaaagcgaatgaaatcgccgtccatttggatcgctccatcggagttgctctgtctggccgccaaatggggacgtgacggacaccgagtgaactcgtgcggtgtgtccgcttcacatctaaatttaggtaaaaaaatgaatccgtatggacatgttttgagaatgggtcgttacgttgcgacaatatttttatccacaacgacctaaacaaatgcgggcagatgaaatgtatggctgcgttggagatgctgttaacggagcaaagtcgttggtagtcggaccgagcaaagtaattgctgaggcaggtagtggacgagactgtagaaaggttccacgcttaatatcttgagcagtacttgtagcacatgtgtccctgcaaagctgtctccgtgctgtataccatgtgaattgcttttctcaaaagtagtggagtaccctaccgtgtttcattagtcttgccggcttcatagacaaaggattcttttttcccgtgccatcgccatctgcaagcccaaatcaacacacaccagagagagagagagagagagagagagagagagagcaacaatggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctagatgcctaaaccgagatgcgcctttggttatggagcccaagtcacgtactcggattggatgctgcagcaaatgatacttctgtacatgtctgcaagtatcacgaattagtggaatgactaggaataagtaagacaagtatcacgaattcagagtcggatgcaatttttttcttttcttttgggcataagtagattgtcatttgagtatttttttccattaatatttgtgtattcttagattgagactttgatatgtaacccagatttctgttgttaggaaacacataccgtgtagcttatcagaagaaaaagatctagcgtgcatctatattctatcggactatgatatttggcacatgtgtgccatataaacaaaactgtcacacctctatttccttcactctaaatagatgtatacattagtttgattctttcttctttcacgtgcatttctccttctaattagatgcatacattagaggacaaaaaagacgatgtcattctagattttctttattaaaatatttaaaatgttttgtagctcaaaccgtcggtccgatgtaaaaaccgtttttacatatacgattcgtcgcgatgagatctttgaaactagatcctatgttgacatgtttcgatgactttttttaaccaaaatttaccatgccttttatatgcaagttaccgtgctatttccacataagtcatcggaggcataaaaatggttcaccgacactacagttcatatattaccatgatgtttacatataagttaccgggagggggggggggggtgtctgttttcaataatttccccaccgagtcaaatattaccatagtatatgtacgtaagttatcaggtatccgatgggtatattaccatggctatcttttaaaaaaatctctaatttaccgcggtgtttgtatctaaattatcaagtttgtggtgcctaatttactatgctatttacatacaaaagttaccagtgtattttttgacaattttttactattcttccccaaatcaagactattaccgtgctgtttacacacaagttaccgggtatattttcaacaacttcatccacccgaatcaaacttatcatgatgtttgtgagtaacttatcatgtctgcaatgcgtatattaccattctatttaaacaaaatttaccaacgatatgcttcaaacaattttttacgtgggtcaaagctagcatactgtttttgcgtaagttattgtatctgcaataaatatattaccgtgctatttacctagaagttattgggggtaatgttcttcaacgaaaaaaaattcagggtcaaaaaattattgtggtgtttgaacgagagttattaggtctccgatgggtaaattatcatgttatttgcacataaattaccgagggtatgcttttcaacaacttcctccatccaggtcaaagttatcatggtgtttttgctcaagttttcaagtttgtggtgcgtatattaccacgatgttgactgtttacaaggtttttgagtcgccgactaatcgccgactaatcgtcgagtcgtcgcggcg

SEQ ID NO: 2 - protein, 941 aa, Triticum aestivum
  DOMAIN (120)..(147): coiled-coil domain
  DOMAIN (178)..(465): nucleotide binding domain
  DOMAIN (601)..(853): leucine-rich repeat domain
MAEVLVSASTGAMGSLLRKLGAMLTDEYKLLKNVRGDIKFLKDELEVMCAFLLKMSDVEEPDEPTKLRVTAVREMSYKIEDNIDKFMVLVEQEHGSSCSEAAHGVAKLMDKCKNLLPDIKARRRIAKEVKDIKKEIKDVSDRFSRYKIDDSSSSMPAKDKVDPRLRAVYKDAAELVGIDGPKDELVKWLNEKEGQSLKSVSIVGYGGLGKTTLANQIRVNLGATFDCGAFVSISRKPDMKAILRSILSQITKKDDACSRLDDIQLIIDKIREFLQDTRYFIIIDDIWELGTWETLKCAFVKNTLGSRIIITTRIVDVAKSCSPSSEDLVYEMKPLSEADSKKLFFKRIFGCEESCPDSLKEAANDILKKCRGLPLAINAISSVLVTTRETKEEWDRVRHSIRSSKVKSDIIETMNYILSLSYFDLPHHLRSCLLYLALFPEDQLIGRKRLVRRWISEGFIHGESGQDLMELGEEYFHQLVNRSLIQPGNIGYDGKAMYCRVHDTILDFLIDKSSEENMCTVLKKQCKPNGIVRRLSLMGNEDEEIVEQLDLSHARSITAFGDIKLLPSLGRSKCLRVLDLQDCDQLENHHIKDIERLYQLRYLDISSTGITELPRQIGELLYLETLVAYGLRELPESTSRLQRLARLFVYSGCKLPGGLGNLINLQELDCVDALHLKHVEELGKLTNLRKLSIKLDTGGIEGNKLEESKEKLVSSLCKLDECGLLSLSIDYYLREKDGEEPFLPALGCIQEVFVYGQDISRISRWLASLPNLHRLLLDDPKIEQQDIEMIGLIPNLIDLTLPPLYKTDDAGRLIIRREGFQQLQKFEAYNTRMGVLMFEPGAMPRLKELKLHNFIEKPKSAAVDFDFGIQRLSSLARLTVSLSCGGWTVAEVEAAEDAFKSMAEANPNRPILEMTRYNTQHMLQDEQIGMTGSATTPAVKS

SEQ ID NO: 3 - DNA, 2823 bp, Triticum aestivum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcagctacaacgccggccgtcaagtcc

SEQ ID NO: 4 - DNA, 8066 bp, Triticum monococcum
aactacctgggtgactgtatttatcctcagtggaccactattgtcaagacagtacccaaccatgtcggagagaagaggaaaagatttgcccaaaagcaagagagtgctaggaaggatgtcgagcgtgcctttggtgttttgcaatctcgatggggcatcgttcggtatcctgctaatacctggagcacgcagaaactgtgggaggtgatgactgcttgtgtgatcatgcacaatatgatcgtagaagacaagcgcccggaacgtctgtacgatcaagggtttcagtttcaggatgagaatgttgtgcctgagcatggagtagcagcaacgtttgaatagttcacccaatttcatcaagacatgcgtgattgggaaactcacgtgcagctgcaaaataatttgattgagtatatgtgggtcatgttggcaaccaataaatgtatcttcttttattcgtttgcaaaactatgaaacatttatttttatttgtatccggtttgtaaaactatactattttattctgtaaactatgttatctgacaatatgtttgaatgcaaactaatataatattgggcggccaaccggccgcgttggcacgttgggtgcgctgccgactcaaatctaaaaaaagacggacgccgggcgggcggccgacccaaacgaacaaaaagcggacgaaatcgccgtccatttgggtcgctccatcggagttgctctgtctggccgccaaatggggacgtgacggacaccgagtgaactcgtgcggtgtgtccgcttcacatctaaatttaggtaaaaaaatgaatccgtatggacatgttttgagaatgggtcgttacgttgcgacaatatttttatccacaacgacctaaacaaatgcgggcagatgaaatgtatggctgcgttggagatgctgttaacggagcaaagtcgttggtagtcggaccgagcaaagtaattgctgaggcaggtagtggacgagactgtagaaaggttccacgcttaatatcttgagcagtacttgtagcacatgtgtccctgcaaagctgtctccgtgctgtataccatgtgaattgcttttctcaaaagtagtggagtaccctaccgtgtttcattagtcttgccggcttcatagacaaaggattcttttttcccgtgccatcgccatctgcaagcccaaatcaacacacaccagagagagagagagagagagagagagagagagagagagcaacaatggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtaccagatcttgttctctttacagtactattagtacctaccatcagatttgtgaccgatttgttgccactcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcgcaaatcaccaagaaagacgaggcttgctctagattagatgatatacaactcatcatcgacaagattcgagaattcctccaagacacaaggtatgtatgtgagatctactacgaagtaacattgcttaattagctcatgcataatccgttgcctagaattttgctaatgagattgctttgtgtgatttactttcgtcctcaacttgtatgactgcgcttaaactttcaagtcattgtttcttgcaacttatgtcgatctgttcactaattaagatatagctaaaatgtgtttgccaatttctgtcgccacacattttctaatttgattgccacaggtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacgggttgcttttggacaatccgaagatagagcagcaggatattgagatgattggattgatacccaatctgatcgatttgacactgtatttacgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctaccacttcatcgaaaagcccaaatctggtgcggtcgatttcgactttggcatccaacacctctccagccttgctcgcctcactgtcggcttattatgcgttggctcgacggcggcggaagtagaggctgcggaggatgctttcaagagcatggccgaggcgaaccccaaccgtccaatactggagatgacaagactttatccgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctagatgcctaaaccgagatgcgcctttggttatggagcccaagtcacgtactctgattggatgctgcagcaaatgaagctacacatttctattcgggctacctctttttttttgaaactctattcgggctacctctttgtctcaaagctggtgtactcttgtgatttgtgttgcgcaactgatacttctgtgtatgtctgcaagtatcacgaattagtgggaatgactaggaataagtaagacaagtatcacgaattcagagtcacatgcaatttttttcttttcttttgggcataagtagattgccatttgagtattttttccattaatatttgcgtattcttagattgggacttagatatgtaacccagatttctgttgttaggaaacacataccgtgtagcttatcaaaagaaaaagatctttagagaaaataacatcattagattgttcaacttggatgaaaaatgtgaaaatggccaaaccataattaaataacatcattagattgttccctgcaaaaaatacatcattagattgttaaatataattgaaccttttgttgtcttttttctaacatgcacgtggcggtcaaagatgcgtattaaaagactatgtcagcatgtttattgtgagtcttggtatgaatattggtctctcctgattcatccattatgcctggcaacattttctatacaaaaatgtaaattgaattaacatgcagacgactgtcaaagatatactactgtacatcaaagaccacgtcaatgcgtagacagatttgtgtttacaaactaggcgggtagtgggaaaggatcccatatgtgttgaattgttgattatccacttttgctaggaacggatctacatagtaaaagccgaccccccaagttcgccccagaagccgttatttgaaattaaaat

SEQ ID NO: 5 - protein, 938 aa, Triticum monococcum
MAEVLVSASTGAMGSLLRKLGAMLTDEYKLLKNVRGDIKFLKDELEVMCAFLLKMSDVEEPDEPTKLRVTAVREMSYKIEDNIDKFMVLVEHESSCSEAAHGVAKLMDKCKNLLPDIKTRRRIAKEVKDIKKEIKDVSDRFSRYKIDESSSSMPAKGKVDPRLRAVYKDAAELVGIDGPKDELVKWLNEKEGQSLKSVSIVGYGGLGKTTLANQIRVNLGATFDCGAFVSISRKPDMKAILRSILSQITKKDEACSRLDDIQLIIDKIREFLQDTRYFIIIDDIWELGTWETLKCAFVKNTLGSRIIITTRIVDVAKSCSPSSEDLVYEMKPLSEADSKKLFFKRIFGCEESCPDSLKEAANDILKKCRGLPLAINAISSVLVTTRETKEEWDRVRHSIRSSKVKSDIIETMNYILSLSYFDLPHHLRSCLLYLALFPEDQLIGRKRLVRRWISEGFIHGESGQDLMELGEEYFHQLVNRSLIQPGNIGYDGKAMYCRVHDTILDFLIDKSSEENMCTVLKKQCKPNGIVRRLSLMGNEDEEIVEQLDLSHARSITAFGDIKLLPSLGRSKCLRVLDLQDCDQLENHHIKDIERLYQLRYLDISSTGITELPRQIGELLYLETLVAYGLRELPESTSRLQRLARLFVYSGCKLPGGLGNLINLQELDCVDALHLKHVEELGKLTNLRKLSIKLDTGGIEGNKLEESKEKLVSSLCKLDECGLLSLSIDYYLREKDGEEPFLPALGCIQEVFVYGQDISRISRWLASLPNLHGLLLDNPKIEQQDIEMIGLIPNLIDLTLYLRITDDAGRLIIKREGFQQLQRFELSRIRMGDLMFEPGAMPRLKELILYHFIEKPKSGAVDFDFGIQHLSSLARLTVGLLCVGSTAAEVEAAEDAFKSMAEANPNRPILEMTRLYPQHMLQDEQIGMTGSATTPAVKS

SEQ ID NO: 6 - DNA, 2814 bp, Triticum monococcum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcgcaaatcaccaagaaagacgaggcttgctctagattagatgatatacaactcatcatcgacaagattcgagaattcctccaagacacaaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacgggttgcttttggacaatccgaagatagagcagcaggatattgagatgattggattgatacccaatctgatcgatttgacactgtatttacgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctaccacttcatcgaaaagcccaaatctggtgcggtcgatttcgactttggcatccaacacctctccagccttgctcgcctcactgtcggcttattatgcgttggctcgacggcggcggaagtagaggctgcggaggatgctttcaagagcatggccgaggcgaaccccaaccgtccaatactggagatgacaagactttatccgcagcatatgttacaagacgagcaaataggtatgacaggctcagctacaacgccggccgtcaagtcc

SEQ ID NO: 7 - DNA, 5915 bp, Triticum monococcum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacgggttgcttttggactatccgaagatagagcagcaggatattgagatgattggattgatacccaatctgatcgatttgacactgtatttacgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctaccacttcatcgaaaagcccaaatctggtgcggtcgatttcgactttggcatccaacacctctccagccttgctcgcctcactgtcggcttattatgcgttggctcgacggcggcggaagtagaggctgcggaggatgctttcaagagcatggccgaggcgaaccccaaccgtccaatactggagatgacaagactttatccgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctag

SEQ ID NO: 8 - protein, 940 aa, Triticum monococcum
MAEVLVSASTGAMGSLLRKLGAMLTDEYKLLKNVRGDIKFLKDELEVMCAFLLKMSDVEEPDEPTKLRVTAVREMSYKIEDNIDKFMVLVEQEHGSSCSEAAHGVAKLMDKCKNLLPDIKARRRIAKEVKDIKKEIKDVSDRFSRYKIDDSSSSMPAKDKVDPRLRAVYKDAAELVGIDGPKDELVKWLNEKEGQSLKSVSIVGYGGLGKTTLANQIRVNLGATFDCGAFVSISRKPDMKAILRSILSQITKKDDACSRLDDIQLIIDKIREFLQDTRYFIIIDDIWELGTWETLKCAFVKNTLGSRIIITTRIVDVAKSCSPSSEDLVYEMKPLSEADSKKLFFKRIFGCEESCPDSLKEAANDILKKCRGLPLAINAISSVLVTTRETKEEWDRVRHSIRSSKVKSDIIETMNYILSLSYFDLPHHLRSCLLYLALFPEDQLIGRKRLVRRWISEGFIHGESGQDLMELGEEYFHQLVNRSLIQPGNIGYDGKAMYCRVHDTILDFLIDKSSEENMCTVLKKQCKPNGIVRRLSLMGNEDEEIVEQLDLSHARSITAFGDIKLLPSLGRSKCLRVLDLQDCDQLENHHIKDIERLYQLRYLDISSTGITELPRQIGELLYLETLVAYGLRELPESTSRLQRLARLFVYSGCKLPGGLGNLINLQELDCVDALHLKHVEELGKLTNLRKLSIKLDTGGIEGNKLEESKEKLVSSLCKLDECGLLSLSIDYYLREKDGEEPFLPALGCIQEVFVYGQDISRISRWLASLPNLHGLLLDYPKIEQQDIEMIGLIPNLIDLTLYLRITDDAGRLIIKREGFQQLQRFELSRIRMGDLMFEPGAMPRLKELILYHFIEKPKSGAVDFDFGIQHLSSLARLTVGLLCVGSTAAEVEAAEDAFKSMAEANPNRPILEMTRLYPQHMLQDEQIGMTGSATTPAVKS

SEQ ID NO: 9 - DNA, 2820 bp, Triticum monococcum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacgggttgcttttggactatccgaagatagagcagcaggatattgagatgattggattgatacccaatctgatcgatttgacactgtatttacgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctaccacttcatcgaaaagcccaaatctggtgcggtcgatttcgactttggcatccaacacctctccagccttgctcgcctcactgtcggcttattatgcgttggctcgacggcggcggaagtagaggctgcggaggatgctttcaagagcatggccgaggcgaaccccaaccgtccaatactggagatgacaagactttatccgcagcatatgttacaagacgagcaaataggtatgacaggctcagctacaacgccggccgtcaagtcc

SEQ ID NO: 10 - DNA, 5915 bp, Triticum monococcum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacgggttgcttttggacaatccgaagatagagcagcaggatattgagatgattggattgatacccaatctgatcgatttgacactgtatttacgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctaccacttcatcgaaaagcccaaatctggtgcggtcgatttcgactttggcatccaacacctctccagccttgctcgcctcactgtcggcttattatgcgttggctcgacggcggcggaagtagaggctgcggaggatgctttcaagagcatggccgaggcgaaccccaaccgtccaatactggagatgacaagactttatccgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctag

SEQ ID NO: 11 - protein, 940 aa, Triticum monococcum
MAEVLVSASTGAMGSLLRKLGAMLTDEYKLLKNVRGDIKFLKDELEVMCAFLLKMSDVEEPDEPTKLRVTAVREMSYKIEDNIDKFMVLVEQEHGSSCSEAAHGVAKLMDKCKNLLPDIKARRRIAKEVKDIKKEIKDVSDRFSRYKIDDSSSSMPAKDKVDPRLRAVYKDAAELVGIDGPKDELVKWLNEKEGQSLKSVSIVGYGGLGKTTLANQIRVNLGATFDCGAFVSISRKPDMKAILRSILSQITKKDDACSRLDDIQLIIDKIREFLQDTRYFIIIDDIWELGTWETLKCAFVKNTLGSRIIITTRIVDVAKSCSPSSEDLVYEMKPLSEADSKKLFFKRIFGCEESCPDSLKEAANDILKKCRGLPLAINAISSVLVTTRETKEEWDRVRHSIRSSKVKSDIIETMNYILSLSYFDLPHHLRSCLLYLALFPEDQLIGRKRLVRRWISEGFIHGESGQDLMELGEEYFHQLVNRSLIQPGNIGYDGKAMYCRVHDTILDFLIDKSSEENMCTVLKKQCKPNGIVRRLSLMGNEDEEIVEQLDLSHARSITAFGDIKLLPSLGRSKCLRVLDLQDCDQLENHHIKDIERLYQLRYLDISSTGITELPRQIGELLYLETLVAYGLRELPESTSRLQRLARLFVYSGCKLPGGLGNLINLQELDCVDALHLKHVEELGKLTNLRKLSIKLDTGGIEGNKLEESKEKLVSSLCKLDECGLLSLSIDYYLREKDGEEPFLPALGCIQEVFVYGQDISRISRWLASLPNLHGLLLDNPKIEQQDIEMIGLIPNLIDLTLYLRITDDAGRLIIKREGFQQLQRFELSRIRMGDLMFEPGAMPRLKELILYHFIEKPKSGAVDFDFGIQHLSSLARLTVGLLCVGSTAAEVEAAEDAFKSMAEANPNRPILEMTRLYPQHMLQDEQIGMTGSATTPAVKS

SEQ ID NO: 12 - DNA, 2820 bp, Triticum monococcum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacgggttgcttttggacaatccgaagatagagcagcaggatattgagatgattggattgatacccaatctgatcgatttgacactgtatttacgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctaccacttcatcgaaaagcccaaatctggtgcggtcgatttcgactttggcatccaacacctctccagccttgctcgcctcactgtcggcttattatgcgttggctcgacggcggcggaagtagaggctgcggaggatgctttcaagagcatggccgaggcgaaccccaaccgtccaatactggagatgacaagactttatccgcagcatatgttacaagacgagcaaataggtatgacaggctcagctacaacgccggccgtcaagtcc

SEQ ID NO: 13 - DNA, 5915 bp, Triticum monococcum
atggcggaagttctggtgagcgcatccacaggcgcaatgggttccctcctccggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtaccagatcttgttctctttacagtactattagtacctaccatcagatttgtgaccgatttgttgccactcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccatcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagttggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccatggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcggcattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcttgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcggagtattgccgagtccatgacaccatccttgatttcctaattgacaaatcctctgaagagaacatgtgtactgtcctgaagaaacaatgcaagcctaatggcatagttcgtcggctctctctaatggggaatgaggatgaagaaatcatggagcaattggatctgtcacacgctcggtcaatcagtgcttttggggatatcaagctattgccttcgcttgggaggtcaaaatgcttgcgcgtgctagacttgcaaggctgctatcagttgaaaaatcatcatatcaaggatattgaaagactctatcagctgagatacttggatatctcttttacaggaatcacggagcttcccaggcaaattggggagttgctgtatctagagacgctagttagtacatcctatggattacgtgagcttcctgaaagcacaagtcggctacaacgactggcacgtttgtttgttgacagcggttgtaagcttccagatgggttgggaaacttgataaacttgcaagagcttgactgcgttgatgccttgcagttgaagcatgtggaagagctcggcaaactaacaaatctgagaaagctgaggattaaattggacactgatgggattgaaggcaacaaattagaacagtccaaggaaaagctggtgtcctctctctgtaaactggacgaatgcggcctcctttccctgagtatttattattatctgagagaaaaggatggagaagagccgttcctccctgctttgggttgtatccaggaggtttttgtacatggacaagatatcagccggattagcagatggctcgcgtcacttcccaacctacacaggttgtttttgaaccaaccgaagatagagcagcaggatattgagatgattggattgatacccaatctgatggatttgacactgtatttatgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctacgacttcatcggaaagcccaaatctggtgcggtcgatttcgactttggcatccaacacctctccagccttgctcgcctcactgtcggcttatcctgcgttggctcgacggtggcggaagtagaggccgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcggtagatcaaaagatgtgcatatgcttcaatcttttttccggtaatctatttcagctacaacgccggccgtcaagtcctag

SEQ ID NO: 14 - protein, 940 aa, Triticum monococcum
MAEVLVSASTGAMGSLLRKLGAMLTDEYKLLKNVRGDIKFLKDELEVMCAFLLKMSDVEEPDEPTKLRVTAVREMSYKIEDNIDKFMVLVEHESSCSEAAHGVAKLMDKCKNLLPDIKTRRRIAKEVKDIKKEIKDVSDRFSRYKIDESSSSMPAKGKVDPRLRAVYKDAAELVGIDGPKDELVKWLNEKEGQSLKSVSIVGYGGLGKTTLANQIRVNLGATFDCGAFVSISRKPDMKAILRSILSQITKKDDACSRLDDIQLIIDKIREFLQDTRYFIIIDDIWELGTWETLKCAFVKNTLGSRIIITTRIVDVAKSCSPSSEDLVYEMKPLSEADSKKLFFKRIFGCEESCPDSLKEAANDILKKCRGLPLAINAISSLLVTTRETKEEWDRVRHSIRSSKVKSDIIETMNYILSLSYFDLPHHLRSCLLYLALFPEDQLIGRKRLVRRWISEGFIHGESGQDLMELGEEYFHQLVNRSLIQPGNIGYDGKAEYCRVHDTILDFLIDKSSEENMCTVLKKQCKPNGIVRRLSLMGNEDEEIMEQLDLSHARSISAFGDIKLLPSLGRSKCLRVLDLQGCYQLKNHHIKDIERLYQLRYLDISFTGITELPRQIGELLYLETLVSTSYGLRELPESTSRLQRLARLFVDSGCKLPDGLGNLINLQELDCVDALQLKHVEELGKLTNLRKLRIKLDTDGIEGNKLEQSKEKLVSSLCKLDECGLLSLSIYYYLREKDGEEPFLPALGCIQEVFVHGQDISRISRWLASLPNLHRLFLNQPKIEQQDIEMIGLIPNLMDLTLYLCITDDAGRLIIKREGFQQLQRFELSRIRMGDLMFEPGAMPRLKELILYDFIGKPKSGAVDFDFGIQHLSSLARLTVGLSCVGSTVAEVEAAEDAFKSMAEANPNRPILEMTRYNTQHMLQDEQIGMTGSATTPAVKS

SEQ ID NO: 15 - DNA, 2820 bp, Triticum monococcum
atggcggaagttctggtgagcgcatccacaggcgcaatgggttccctcctccggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcttgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcggagtattgccgagtccatgacaccatccttgatttcctaattgacaaatcctctgaagagaacatgtgtactgtcctgaagaaacaatgcaagcctaatggcatagttcgtcggctctctctaatggggaatgaggatgaagaaatcatggagcaattggatctgtcacacgctcggtcaatcagtgcttttggggatatcaagctattgccttcgcttgggaggtcaaaatgcttgcgcgtgctagacttgcaaggctgctatcagttgaaaaatcatcatatcaaggatattgaaagactctatcagctgagatacttggatatctcttttacaggaatcacggagcttcccaggcaaattggggagttgctgtatctagagacgctagttagtacatcctatggattacgtgagcttcctgaaagcacaagtcggctacaacgactggcacgtttgtttgttgacagcggttgtaagcttccagatgggttgggaaacttgataaacttgcaagagcttgactgcgttgatgccttgcagttgaagcatgtggaagagctcggcaaactaacaaatctgagaaagctgaggattaaattggacactgatgggattgaaggcaacaaattagaacagtccaaggaaaagctggtgtcctctctctgtaaactggacgaatgcggcctcctttccctgagtatttattattatctgagagaaaaggatggagaagagccgttcctccctgctttgggttgtatccaggaggtttttgtacatggacaagatatcagccggattagcagatggctcgcgtcacttcccaacctacacaggttgtttttgaaccaaccgaagatagagcagcaggatattgagatgattggattgatacccaatctgatggatttgacactgtatttatgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctacgacttcatcggaaagcccaaatctggtgcggtcgatttcgactttggcatccaacacctctccagccttgctcgcctcactgtcggcttatcctgcgttggctcgacggtggcggaagtagaggccgcggaggatgctttcaagagcatggccgaggcgaaccccaaccgtccaatactggagatgacaagatataatacgcagcatatgttacaagacgagcaaataggtatgacaggctcagctacaacgccggccgtcaagtcc

SEQ ID NO: 16 - DNA, 5914 bp, Triticum monococcum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatcttttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcgggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccaggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcatgatccggacgtttctagtcactgccatgcgggcccgaggtaggtgggcggcattgactacgtctgtggtggtagttggctggcagacacgccagcccgaggcgcacaccgagcagacgtgcaacacgtccgtctcatgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcttgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcagtgcttttggggatatcaagctattgccttcgcttgggaggtcaaaatgcttgcgtgtgctagacttgcaagactgcgatcagttggaaaatcatcatatcaaggatattgaaagactctatcagctgagatacttggatatctcttatacaggaatcacggagcttccgaggcaaattggggagttgctgtatctagagacgctagatgcctctggattacgtgagcttcctgaaagcacaagtcggctacaacgactggcacgtttgtttgttgacagcggttgtaagcttccagatgggttgggaaacttgataaacttgcaagagcttgactgcgttgatgccttgcagttgaagcatgtggaagagctcggcaaactaacaaatctgagaaagctgaagattaaattggacactggtgggattgaaggcaacaaattagaagagtccaaggaaaagctggtgtcctctctctgtaaactggacgaatgcggcctccgttccctgagtattcgttattatctgagagaaaaggatggagaagagccgttcctccctgctttgggttgtatccaggaggtttgtgtatatggacaagatatcagccggattagcagatggctcgcgtcacttcccaacctacacacgttgcttttggactatccgaagatagagcagcaggatattgagatgattggattgatacccaatctgatcgatttgacactgcctctatacaaaacagacgacgctgggcggctcatcatcaggcgtgaaggatttcaacagttgcagaagtttgaggcttacaatactcgtatgggggttttaatgtttgaaccgggggttatgccgaggctcaaggagcttaaactccataacttcatcgaaaagcccaaatctgctgcggtcgatttcgactttggcatccaacacctctccagccttgctcgcctcactgtcgacttatcctgcgttggctggacggcggcggaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctag

SEQ ID NO: 17 - protein, 940 aa, Triticum monococcum
MAEVLVSASTGAMGSLLRKLGAMLTDEYKLLKNVRGDIKFLKDELEVMCAFLLKMSDVEEPDEPTKLRVTAVREMSYKIEDNIDKFMVLVEQEHGSSCSEAAHGVAKLMDKCKNLLPDIKARRRIAKEVKDIKKEIKDVSDRFSRYKIDDSSSSMPAKDKVDPRLRAVYKDAAELVGIDGPKDELVKWLNEKEGQSLKSVSIVGYGGLGKTTLANQIRVNLGATFDCGAFVSISRKPDMKAILRSILSQITKKDDACSRLDDIQLIIDKIREFLQDTRYFIIIDDIWELGTWETLKCAFVKNTLGSRIIITTRIVDVAKSCSPSSEDLVYEMKPLSEADSKKLFFKRIFGCEESCPDSLKEAANDILKKCRGLPLAINAISSLLVTTRETKEEWDRVRHSIRSSKVKSDIIETMNYILSLSYFDLPHHLRSCLLYLALFPEDQLIGRKRLVRRWISEGFIHGESGQDLMELGEEYFHQLVNRSLIQPGNIGYDGKAMYCRVHDTILDFLIDKSSEENMCTVLKKQCKPNGIVRRLSLMGNEDEEIVEQLDLSHARSISAFGDIKLLPSLGRSKCLRVLDLQDCDQLENHHIKDIERLYQLRYLDISYTGITELPRQIGELLYLETLDASGLRELPESTSRLQRLARLFVDSGCKLPDGLGNLINLQELDCVDALQLKHVEELGKLTNLRKLKIKLDTGGIEGNKLEESKEKLVSSLCKLDECGLRSLSIRYYLREKDGEEPFLPALGCIQEVCVYGQDISRISRWLASLPNLHTLLLDYPKIEQQDIEMIGLIPNLIDLTLPLYKTDDAGRLIIRREGFQQLQKFEAYNTRMGVLMFEPGVMPRLKELKLHNFIEKPKSAAVDFDFGIQHLSSLARLTVDLSCVGWTAAEVEAAEDAFKSMAEANPNRPILEMTRYNTQHMLQDEQIGMTGSATTPAVKS

SEQ ID NO: 18 - DNA, 2820 bp, Triticum monococcum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcttgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcagtgcttttggggatatcaagctattgccttcgcttgggaggtcaaaatgcttgcgtgtgctagacttgcaagactgcgatcagttggaaaatcatcatatcaaggatattgaaagactctatcagctgagatacttggatatctcttatacaggaatcacggagcttccgaggcaaattggggagttgctgtatctagagacgctagatgcctctggattacgtgagcttcctgaaagcacaagtcggctacaacgactggcacgtttgtttgttgacagcggttgtaagcttccagatgggttgggaaacttgataaacttgcaagagcttgactgcgttgatgccttgcagttgaagcatgtggaagagctcggcaaactaacaaatctgagaaagctgaagattaaattggacactggtgggattgaaggcaacaaattagaagagtccaaggaaaagctggtgtcctctctctgtaaactggacgaatgcggcctccgttccctgagtattcgttattatctgagagaaaaggatggagaagagccgttcctccctgctttgggttgtatccaggaggtttgtgtatatggacaagatatcagccggattagcagatggctcgcgtcacttcccaacctacacacgttgcttttggactatccgaagatagagcagcaggatattgagatgattggattgatacccaatctgatcgatttgacactgcctctatacaaaacagacgacgctgggcggctcatcatcaggcgtgaaggatttcaacagttgcagaagtttgaggcttacaatactcgtatgggggttttaatgtttgaaccgggggttatgccgaggctcaaggagcttaaactccataacttcatcgaaaagcccaaatctgctgcggtcgatttcgactttggcatccaacacctctccagccttgctcgcctcactgtcgacttatcctgcgttggctggacggcggcggaagtagaggctgcggaggatgctttcaagagcatggccgaggcgaaccccaaccgtccaatactggagatgacaagatataatacgcagcatatgttacaagacgagcaaataggtatgacaggctcagctacaacgccggccgtcaagtcc

SEQ ID NO: 19 - DNA, 5912 bp, Triticum boeoticum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccagcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctag

SEQ ID NO: 20 - protein, 939 aa, Triticum boeoticum
MAEVLVSASTGAMGSLLRKLGAMLTDEYKLLKNVRGDIKFLKDELEVMCAFLLKMSDVEEPDEPTKLRVTAVREMSYKIEDNIDKFMVLVEHGSSCSEAAHGVAKLMDKCKNLLPDIKARRRIAKEVKDIKKEIKDVSDRFSRYKIDDSSSSMPAKDKVDPRLRAVYKDAAELVGIDGPKDELVKWLNEKEGQSLKSVSIVGYGGLGKTTLANQIRVNLGATFDCGAFVSISRKPDMKAILRSILSQITKKDDACSRLDDIQLIIDKIREFLQDTRYFIIIDDIWELGTWETLKCAFVKNTLGSRIIITTRIVDVAKSCSPSSEDLVYEMKPLSEADSKKLFFKRIFGCEESCPDSLKEAANDILKKCRGLPLAINAISSVLVTTRETKEEWDRVRHSIRSSKVKSDIIETMNYILSLSYFDLPHHLRSCLLYLALFPEDQLIGRKRLVRRWISEGFIHGESGQDLMELGEEYFHQLVNRSLIQPGNIGYDGKAMYCRVHDTILDFLIDKSSEENMCTVLKKQCKPNGIVRRLSLMGNEDEEIVEQLDLSHARSITAFGDIKLLPSLGRSKCLRVLDLQDCDQLENHHIKDIERLYQLRYLDISSTGITELPRQIGELLYLETLVAYGLRELPESTSRLQRLARLFVYSGCKLPGGLGNLINLQELDCVDALHLKHVEELGKLTNLRKLSIKLDTGGIEGNKLEESKEKLVSSLCKLDECGLLSLSIDYYLREKDGEEPFLPALGCIQEVFVYGQDISRISRWLASLPNLHRLLLDDPKIEQQDIEMIGLIPNLIDLTLPPLYKTDDAGRLIIRREGFQQLQKFEAYNTRMGVLMFEPGAMPRLKELKLHNFIEKPKSAAVDFDFGIQRLSSLARLTVSLSCGGWTVAEVEAAEDAFKSMAEANPNRPILEMTRYNTQHMLQDEQIGMTGSATTPAVKS

SEQ ID NO: 21 - DNA, 2817 bp, Triticum boeoticum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcagctacaacgccggccgtcaagtcc

SEQ ID NO: 22 - DNA, 5912 bp, Triticum boeoticum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtaccagatcttgttctctttacagtactattagtacctaccatcagatttgtgaccgatttgttgccactcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcgcaaatcaccaagaaagacgaggcttgctctagattagatgatatacaactcatcatcgacaagattcgagaattcctccaagacacaaggtatgtatgtgagatctactacgaagtaacattgcttaattagctcatgcataatccgttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcaagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcacgcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctag

SEQ ID NO: 23 - protein, 939 aa, Triticum boeoticum
MAEVLVSASTGAMGSLLRKLGAMLTDEYKLLKNVRGDIKFLKDELEVMCAFLLKMSDVEEPDEPTKLRVTAVREMSYKIEDNIDKFMVLVEHESSCSEAAHGVAKLMDKCKNLLPDIKTRRRIAKEVKDIKKEIKDVSDRFSRYKIDESSSSMPAKGKVDPRLRAVYKDAAELVGIDGPKDELVKWLNEKEGQSLKSVSIVGYGGLGKTTLANQIRVNLGATFDCGAFVSISRKPDMKAILRSILSQITKKDEACSRLDDIQLIIDKIREFLQDTRYFIIIDDIWELGTWETLKCAFVKNTLGSRIIITTRIVDVAKSCSPSSEDLVYEMKPLSEADSKKLFFKRIFGCEESCPDSLKEAANDILKKCRGLPLAINAISSVLVTTRETKEEWDRVRHSIRSSKVKSDIIETMNYILSLSYFDLPHHLRSCLLYLALFPEDQLIGRKRLVRRWISEGFIHGESGQDLMELGEEYFHQLVNRSLIQPGNIGYDGKAMYCRVHDTILDFLIDKSSEENMCTVLKKQCKPNGIVRRLSLMGNEDEEIVEQLDLSHARSITAFGDIKLLPSLGRSKCLRVLDLQDCDQLENHHIKDIERLYQLRYLDISSTGITELPRQIGELLYLETLVAYGLRELPESTSRLQRLARLFVYSGCKLPGGLGNLINLQELDCVDALHLKHVEELGKLTNLRKLSIKLDTGGIEGNKLEESKEKLVSSLCKLDECGLLSLSIDYYLREKDGEEPFLPALGCIQEVFVYGQDISRISRWLASLPNLHRLLLDDPKIEQQDIEMIGLIPNLIDLTLPPLYKTDDAGRLIIRREGFQQLQKFEAYNTRMGVLMFEPGAMPRLKELKLHNFIEKPKSAAVDFDFGIQRLSSLARLTVSLSCGGWTVAEVEAAEDAFKSMAEANPNRPILEMTRYNTQHMLQDEQIGMTGSATTPAVKS

SEQ ID NO: 24 - DNA, 2817 bp, Triticum boeoticum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcgcaaatcaccaagaaagacgaggcttgctctagattagatgatatacaactcatcatcgacaagattcgagaattcctccaagacacaaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcagctacaacgccggccgtcaagtcc

SEQ ID NO: 25 - DNA, 5911 bp, Triticum boeoticum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtaccagatcttgttctctttacagtactattagtacctaccatcagatttgtgaccgatttgttgccactcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcgcaaatcaccaagaaagacgaggcttgctctagattagatgatatacaactcatcatcgacaagattcgagaattcctccaagacacaaggtatgtatgtgagatctactacgaagtaacattgcttaattagctcatgcataatccgttgcctagaattttgctaatgagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcaagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctag

SEQ ID NO: 26 - protein, 939 aa, Triticum boeoticum; identical to SEQ ID NO: 23

SEQ ID NO: 27 - DNA, 2817 bp, Triticum boeoticum; identical to SEQ ID NO: 24

SEQ ID NO: 28 - DNA, 5919 bp, Triticum boeoticum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctccttctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtaccagatcttgttctctttacagtactattagtacctaccatcagatttgtgaccgatttgttgccactcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatcttttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccatcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagttggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccatggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcggcattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcttgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaaagtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcatggagcaattggatctgtcacacgctcggtcaatcagtgcttttggggatatcaagctattgccttcgcttgggaggtcaaaatgcttgcgcgtgctagacttgcaaggctgctatcagttgaaaaatcatcatatcaaggatattgaaagactctatcagctgagatacttggatatctcttttacaggaatcacggagcttcccaggcaaattggggagttgctgtatctagagacgctagttagtacatcctatggattacgtgagcttcctgaaagcacaagtcggctacaacgactggcacgtttgtttgttgacagcggttgtaagcttccagatgggttgggaaacttgataaacttgcaagagcttgactgcgttgatgccttgcagttgaagcatgtggaagagctcggcaaactaacaaatctgagaaagctgaggattaaattggacactgatgggattgaaggcaacaaattagaacagtccaaggaaaagctggtgtcctctctctgtaaactggacgaatgcggcctcctttccctgagtatttattattatctgagagaaaaggatggagaagagccgttcctccctgctttgggttgtatccaggaggtttttgtacatggacaagatatcagccggattagcagatggctcgcgtcacttcccaacctacacaggttgtttttgaaccaaccgaagatagagcagcaggatattgagatgattgcattgagagagcccaatctgatggatttgacactgtatttatgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctacgacttcatcggaaagcccaaatctggtgcggtcgatttcgactttggcatccaacacctctccagccttgctcgcctcactgtcggcttatcctgcgttggctcgacggtggcggaagtagaggccgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcggtagatcaaaagatgtgcatatgcttcaatcttttttccggtaatctatttcagctacaacgccggccgtcaagtcctag

SEQ ID NO: 29 - protein, 941 aa, Triticum boeoticum
MAEVLVSASTGAMGSLLRKLGAMLTDEYKLLKNVRGDIKFLKDELEVMCAFLLKMSDVEEPDEPTKLRVTAVREMSYKIEDNIDKFMVLVEHESSFSEAAHGVAKLMDKCKNLLPDIKTRRRIAKEVKDIKKEIKDVSDRFSRYKIDESSSSMPAKGKVDPRLRAVYKDAAELVGIDGPKDELVKWLNEKEGQSLKSVSIVGYGGLGKTTLANQIRVNLGATFDCGAFVSISRKPDMKAILRSILSQITKKDDACSRLDDIQLIIDKIREFLQDTRYFIIIDDIWELGTWETLKCAFVKNTLGSRIIITTRIVDVAKSCSPSSEDLVYEMKPLSEADSKKLFFKRIFGCEESCPDSLKEAANDILKKCRGLPLAINAISSLLVTTRETKEEWDRVRHSIRSSKVKSDIIETMNYILSLSYFDLPHHLRSCLLYLALFPEDQLIGRKRLVRRWISEGFIHGESGQDLMELGEEYFHQLVNRSLIQPGNIGYDGKAKYCRVHDTILDFLIDKSSEENMCTVLKKQCKPNGIVRRLSLMGNEDEEIMEQLDLSHARSISAFGDIKLLPSLGRSKCLRVLDLQGCYQLKNHHIKDIERLYQLRYLDISFTGITELPRQIGELLYLETLVSTSYGLRELPESTSRLQRLARLFVDSGCKLPDGLGNLINLQELDCVDALQLKHVEELGKLTNLRKLRIKLDTDGIEGNKLEQSKEKLVSSLCKLDECGLLSLSIYYYLREKDGEEPFLPALGCIQEVFVHGQDISRISRWLASLPNLHRLFLNQPKIEQQDIEMIALREPNLMDLTLYLCITDDAGRLIIKREGFQQLQRFELSRIRMGDLMFEPGAMPRLKELILYDFIGKPKSGAVDFDFGIQHLSSLARLTVGLSCVGSTVAEVEAAEDAFKSMAEANPNRPILEMTRYNTQHMLQDEQIGMTGSATTPAVKS

SEQ ID NO: 30 - DNA, 2823 bp, Triticum boeoticum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctccttctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcttgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaaagtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcatggagcaattggatctgtcacacgctcggtcaatcagtgcttttggggatatcaagctattgccttcgcttgggaggtcaaaatgcttgcgcgtgctagacttgcaaggctgctatcagttgaaaaatcatcatatcaaggatattgaaagactctatcagctgagatacttggatatctcttttacaggaatcacggagcttcccaggcaaattggggagttgctgtatctagagacgctagttagtacatcctatggattacgtgagcttcctgaaagcacaagtcggctacaacgactggcacgtttgtttgttgacagcggttgtaagcttccagatgggttgggaaacttgataaacttgcaagagcttgactgcgttgatgccttgcagttgaagcatgtggaagagctcggcaaactaacaaatctgagaaagctgaggattaaattggacactgatgggattgaaggcaacaaattagaacagtccaaggaaaagctggtgtcctctctctgtaaactggacgaatgcggcctcctttccctgagtatttattattatctgagagaaaaggatggagaagagccgttcctccctgctttgggttgtatccaggaggtttttgtacatggacaagatatcagccggattagcagatggctcgcgtcacttcccaacctacacaggttgtttttgaaccaaccgaagatagagcagcaggatattgagatgattgcattgagagagcccaatctgatggatttgacactgtatttatgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctacgacttcatcggaaagcccaaatctggtgcggtcgatttcgactttggcatccaacacctctccagccttgctcgcctcactgtcggcttatcctgcgttggctcgacggtggcggaagtagaggccgcggaggatgctttcaagagcatggccgaggcgaaccccaaccgtccaatactggagatgacaagatataatacgcagcatatgttacaagacgagcaaataggtatgacaggctcagctacaacgccggccgtcaagtcc

SEQ ID NO: 31 - DNA, 5910 bp, Triticum monococcum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtaccagatcttgttctctttacagtactattagtacctaccatcagatttgtgaccgatttgttgccactcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctttgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcagcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcactgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcggcattgactacgtctgtggtggtagttggctggcagacacgccagcccgaggcgcacaccgagcggacgcgcaacacgtccgtctcgtgttcgtgtgaacgcaaatcacgcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactgtgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcttgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccgacaacatagggtatgacggcaaggcaaagtattgccgagtccatgacaccatccttgatttcctaatcgacaaatcctccgaagagaacatgtgtaccgtcctaaagaaacaatgcaagcctaatggcatagttcgtcggctctctctaatggggaatgaggatgaagaaaccgtggagcaattggatctgtcacacgctcggtcaatcactgcttttagggatatcaagctattgccttcgcttgggaggtcaaaatgcttgcgcgtgctagacttgcaagcctgcaatcagttggaaaatcatcatatcaaggacattgaaagactctatcagctgagatacttggatatctcttttacaggaatcacggagcttcccaggcaaattggggagttgctgtatctagagacgctagttacatcctatagattacgtgagcttcctgaaagcacaagtcggctacaacgactggcacgtttgtttgttgaccccggttgtaagcttccagatgggttgggaaacttgataaacttgcaagagcttgattgggttgatgccttgcagttgaagcatgtggaagagctcggcaaactaacaaatctgagaaagctgaggattaaattggacactgatgggatagaaggcaacaaattagaacagtccaaggaaaagctggtgtcctctctctgtaaactggacgaatgcggcctccgttccctgagtattggttattatctgagagaaaaggatggagaagagccgttcctccctcctttgggttgtatccaggaggtttctgtatatggacaagatatcagccggattagcagatggctcgcgtcacttcccaacctacacatgttgtttttcgactatgtgaagatagagcagcaggatattgagatgattggattgatacccaatctgatcgatttgtcactgtctttacgcaaaacagacgacgctgggcggctcatcatcaggcgtgaaggatttcaacatttgcatagttttcgggtttacgatactcgtatgggagttttaatgtttgaaccgggggctatgccgaggctcaaggagcttaaactccataacttcatcgaaaagcccgaatctggtgcggtcgatttcgactttggcatccaacgcctctccagccttgctcgcctcactgtcagcttattctgcgttggctcgacggcggcagaagtagaggctacggaggatgctttcaagagcatggccgaggcgaaccccaaccgtccaatactggagatgataagagttaatccgcaccgcatgttctgagacgagcaaatagatatggcaggctcaggtactattaacaggtttgtactttttgtcttggtgagcagtagatcaaaagatgtgcatatgcttcattctttttccggtcatctatttcagctacgacgccggccgtcaagtcctag

SEQ ID NO: 32 - protein, 938 aa, Triticum monococcum
MAEVLVSASTGAMGSLLRKLGAMLTDEYKLLKNVRGDIKFLKDELEVMCAFLLKMSDVEEPDEPTKLRVTAVREMSYKIEDNIDKFMVLVEHESSCSEAAHGVAKLMDKCKNLLPDIKTRRRIAKEVKDIKKEIKDVSDRFSRYKIDESSSSMPAKGKVDPRLRAVYKDAAELVGIDGPKDELVKWLNEKEGQSLKSVSIVGYGGLGKTTLANQIRVNLGATFDCGAFVSISRKPDMKAILRSILSQITKKDDACSRLDDIQLIIDKIREFLQDTRYFIIIDDIWELGTWETVKCAFVKNTLGSRIIITTRIVDVAKSCSPSSEDLVYEMKPLSEADSKKLFFKRIFGCEESCPDSLKEAANDILKKCRGLPLAINAISSLLVTTRETKEEWDRVRHSIRSSKVKSDIIETMNYILSLSYFDLPHHLRSCLLYLALFPEDQLIGRKRLVRRWISEGFIHGESGQDLMELGEEYFHQLVNRSLIQPDNIGYDGKAKYCRVHDTILDFLIDKSSEENMCTVLKKQCKPNGIVRRLSLMGNEDEETVEQLDLSHARSITAFRDIKLLPSLGRSKCLRVLDLQACNQLENHHIKDIERLYQLRYLDISFTGITELPRQIGELLYLETLVTSYRLRELPESTSRLQRLARLFVDPGCKLPDGLGNLINLQELDWVDALQLKHVEELGKLTNLRKLRIKLDTDGIEGNKLEQSKEKLVSSLCKLDECGLRSLSIGYYLREKDGEEPFLPPLGCIQEVSVYGQDISRISRWLASLPNLHMLFFDYVKIEQQDIEMIGLIPNLIDLSLSLRKTDDAGRLIIRREGFQHLHSFRVYDTRMGVLMFEPGAMPRLKELKLHNFIEKPESGAVDFDFGIQRLSSLARLTVSLFCVGSTAAEVEATEDAFKSMAEANPNRPILEMIRVNPHRMFDEQIDMAGSATTPAVKS

SEQ ID NO: 33 - DNA, 2817 bp, Triticum monococcum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtactttatcataattgatgatatatgggagttaggaacatgggaaactgtgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcttgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccgacaacatagggtatgacggcaaggcaaagtattgccgagtccatgacaccatccttgatttcctaatcgacaaatcctccgaagagaacatgtgtaccgtcctaaagaaacaatgcaagcctaatggcatagttcgtcggctctctctaatggggaatgaggatgaagaaaccgtggagcaattggatctgtcacacgctcggtcaatcactgcttttagggatatcaagctattgccttcgcttgggaggtcaaaatgcttgcgcgtgctagacttgcaagcctgcaatcagttggaaaatcatcatatcaaggacattgaaagactctatcagctgagatacttggatatctcttttacaggaatcacggagcttcccaggcaaattggggagttgctgtatctagagacgctagttacatcctatagattacgtgagcttcctgaaagcacaagtcggctacaacgactggcacgtttgtttgttgaccccggttgtaagcttccagatgggttgggaaacttgataaacttgcaagagcttgattgggttgatgccttgcagttgaagcatgtggaagagctcggcaaactaacaaatctgagaaagctgaggattaaattggacactgatgggatagaaggcaacaaattagaacagtccaaggaaaagctggtgtcctctctctgtaaactggacgaatgcggcctccgttccctgagtattggttattatctgagagaaaaggatggagaagagccgttcctccctcctttgggttgtatccaggaggtttctgtatatggacaagatatcagccggattagcagatggctcgcgtcacttcccaacctacacatgttgtttttcgactatgtgaagatagagcagcaggatattgagatgattggattgatacccaatctgatcgatttgtcactgtctttacgcaaaacagacgacgctgggcggctcatcatcaggcgtgaaggatttcaacatttgcatagttttcgggtttacgatactcgtatgggagttttaatgtttgaaccgggggctatgccgaggctcaaggagcttaaactccataacttcatcgaaaagcccgaatctggtgcggtcgatttcgactttggcatccaacgcctctccagccttgctcgcctcactgtcagcttattctgcgttggctcgacggcggcagaagtagaggctacggaggatgctttcaagagcatggccgaggcgaaccccaaccgtccaatactggagatgataagagttaatccgcaccgcatgttctgagacgagcaaatagatatggcaggctcagctacgacgccggccgtcaagtcc

SEQ ID NO: 34 - DNA, 5908 bp, Triticum aestivum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtaccagatcttgttctctttacagtactattagtacctaccatcagatttgtgaccgatttgttgccactcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcgcaaatcaccaagaaagacgaggcttgctctagattagatgatatacaactcatcatcgacaagattcgagaattcctccaagacacaaggtatgtatgtgagatctactacgaagtaacattgcttaattagctcatgcataatccgttgcctagaattttgctaatgagattgctttgtgtgatttactttcgtcctcaacttgtatgactgcgcttaaactttcaagtcattgtttcttgcaacttatgtcgatctgttcactaattaagatatagctaaaatgtgtttgccaatttctgtcgccacacattttctaatttgattgccacaggtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacgggttgcttttggacaatccgaagatagagcagcaggatattgagatgattggattgatacccaatctgatcgatttgacactgtatttacgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctaccacttcatcgaaaagcccaaatctggtgcggtcgatttcgactttggcatccaacacctctccagccttgctcgcctcactgtcggcttattatgcgttggctcgacggcggcggaagtagaggctgcggaggatgctttcaagagcatggccgaggcgaaccccaaccgtccaatactggagatgacaagactttatccgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctag

SEQ ID NO: 35 - protein, 938 aa, Triticum aestivum; identical to SEQ ID NO: 5

SEQ ID NO: 36 - DNA, 2814 bp, Triticum aestivum; identical to SEQ ID NO: 6

SEQ ID NO: 37 - DNA, 5995 bp, Triticum monococcum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctccagttccgaggctcatggcgtcaccaagctcatggacaagtgcaagaacttgctgccggatatcaagacccgccgcaggatcgccaaggaggtcaaagacatcaagaaagaaattaaggatgtcagcgacagatttttaaggtaccagatcttgttctctttacagtactattagtacctaccatcagatttgcgactgagctgatgcttccatccatctatccgatttgttgccactcaaggtacaagattgacgactcctcctcctctatgcctgctgcaaaagacaaggtcgaccctcgacttcgtgcagtctacaaagacgccgcagagctcgtcggaattgatggaccaaaggatgaacttgtcaagtggctgaatgagaaagagggccaatcacttaaatctgtctctattgttggatatggagggttgggcaagaccacgctcgccaaccagatccgggtcaaccttggagcgactttcgactgcggggcttttgtctcgatttcacgcaagcctgacatgaaggcgatattaagatctatattatcgcaaatcaccaagaaagacgaggcttgccctagattagatgatatacaactcatcatcgacaagattcgagaattcctccaagacacaaggtatatatgtgacatctgctacaaagtagcattgcttaattagctcatgtataatctgttgcctagaatcttgctaatgaagattgctttgtgtgatttacattcgtcctcaacttgtatgaccgcgtttaaaatttgaagtcattgttttttgcaacttatgtcgatctgttcactataagatatagctaaaatctgtatgccgatttctggcgccatacattttctaattgattgccacaggtttgtcaagcttgcggctatgcatggagccagtgaaaacaaataagtacacgcaattcccatttttttacaagacaaatatccgcacgcactacatgactgcaaatatatctactccctccgtctcataatataggatgtttttgacactagtgtagtgtagtgtcaaaaaacgtcttacattacaagatggaaggagtatcttctaagaacccaaagcacttggatgtgcagaccactgttaccggatatgcagtgcattaggtttgtgattaaccactttaagaacatagggtttctagaggctataaacctacggttatcagtattataatcctgaatgcatatcaaacattgaagaacctatatcctaatacaaaaagagaaaaggggggaattaatagaggaattaatcatggtcagaacggaccagcctgactagcgtaacataatgataatcgtagtttgttgcttctttctggtttcgtagcaatttgcatgatgaattgaggcgcagagcctcctaccaatcatgaggaaataacttgttaccaaaaagacaaaagaaaataggtagtcccaatcattgtttcgattctatccttttccgaacatgctattggcagtggcaaaacggaattgctccatgcacgaccttgtgcccgatgcatgcacgacagaaaatccagcggctggtactctttccctcagacgtatgtccggctagatttcattcatggtgcgtgaattgtctgatttatgtcgtgtgtatagcacgactcgtggcaaaacattgtaccttgccactggcaacagcttccttgacccggcctgagcaactcatcaaggaattcataatttttcctcttggttgttaaatcttgctattttttgtttgccttctatggcaatcttttttttcttatattgcaaccaaattgtatctaagagaaactccaacgcgccgacgcagtttttgtccgttcggattggccaagcggacgggggtgtccggttttgcctttgggtgcgtaggcgcgcccaacacggcctacacattagtccgtgtgggcatttaaaaaaacttaaaaagcttaaaataattgaaaaaaaatgcatattaaagcccatcaaagtccacataattaaacataaaacattaaaacactaataagaaacgccgcccagccgccccaacctacagccctaggcatcgtcttcgtcgttggagtggctgaggtcgaagaatgccggcagctcggcccatgggaaggcctgccggtaggatgctagcgctgcctgctctgccatctgctgatgtggtggctctgcctggcgccgcgcgcacctcttcctcgcgttcccaatgaagtcggaactcctcctcgggctcccgttgcatacggaactggccgtcatctcgctcctcctctagcgtgtggtccttccacgccgcgaggtaggccgcctcctcctcctccgtcgcgcccagccaaatgagtagcgcactcacccactcccggacaacaccctgccattagtgaacgctggtgggcacgggtggtgccagcgctggtgcgggcggtgacgatggggccagtggtgccggtaggtagacactatcgcgggcggtcgacagctgcaacgcatcctcgaggccaggccaccaggagtcctcgtgctgggactccaggatgaccaccagtggcagcggtggagggcgggcatggagctggatggcgccgtggcggcgcagatcgtgctcggttgggaaccagacgtcccagttagggagtctggcgtgtaggcggggtcgcggcactgcttcggcgttaggagagcatgcaggcccaaaatcgttggcgcgcgcacactcggactgtggcatggcctgtaccggaatgtggtgggggtcgacgtgccaaccatgggggaggttcacgtccggccacggcagcgggacgcggtactcccagtggtactacgcgtggtgcaccgaggtgtaccggtggcgctgccgcccttccgtcctgatgcaccgacactaatgcgaaccccttcgtcggcggcctcaccggcccttgcaacgagtcggcctcgtggttgtgcttgcccttgcccttgcctttgccgaagaagctcatgacggctagggttttttgtcgccggcgagggagcagatgtggactagagtgggaggagaagtggattaggccggccccgccgtacccttgcaattaaaaaaggcgcagtctgaacacttctagtcactgccatgcgggcccgaggtaggtgggcgggcattaactacgactgcggtggtagttggctggccgacacgcgggcccgaggcggacaccgagtggacgcgcagcacctccgtctcgtgttcgtgcggatgcaaatcaggcgcatttttgtccgttttgacccaaacggacacgagcgcatggaccaaatgcgccggcacgttggagttgcttgtacctagtactatgtgtggagttgttatcttgcagtttcttccccatttgtagctgtgtattattgtgagatgctctcagggatttcacttatcgtacaagtatgttttagacaattacatcaaggtgtattataattaggatgtacacagatgttacattgtttcaggaatttaggttacttgataggtattactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgctctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaagaaatgccgtggtctacctctggccatcaatgccatttctagcctgttggccacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattgaaaggaagcggttggtacgcagatggatttctgaaggctttatccatggagaaagtggacaagctctcatggaattaggagaggaatattttcaccagcttgtgaacagaagtctaatacagcccggcaacatagggtatgacggcaaggcggagtattgccgagtccatgacaccatccttgatttcctaattgacaaatcctctgaagagaacatgtgtactgtcctgaagaaacaatgcaagcctaatggcatagttcgtcggctctctctaatggggaatgaggatgaagaaatcatggagcaattggatctgtcacacgctcggtcaatcagtgcttttggggatatcaagctattgccttcgcttgggaggtcaaaatgcttgcgcgtgctagacttgcaaggctgctatcagttgaaaaatcatcatatcaaggatattgaaagactctatcagctgagatacttggatatctcttttacaggaatcacggagcttcccaggcaaattggggagttgctgtatctagagacgctagttacatcctatggattacgtgagcttcctgaaagcacaagtcggctacaacgactggcacgtttgtttgtttaccacggttgtaagcttccagatgggttgggaaacttggtaaacttgcaagagcttgagtgcgttgatgccttgcagttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctccgttccctgagtattcattattatctgagagaaaaggatggagaagagccgttcctccctgctttgggttgtatccaggaggtttgtgtatatggacaagatatcagccggattagcagatggctcgcgtcacttcccaacctacacaggttgtttttcaacgatcccaaaatgaagatagagcagcaggatattgagatgattggattgatacccaatctgatggatttgacactgtatttacgcataacagacgacgctatgccgaggctcatcatcaagcgtgaaggatttcaacagttgcagaggtttgagctttcccgtattcgtatgggggatttaatgtttgaaccgggggctatgccgaggctcaaggagcttatactccataacttcatcgaaaagcccaaatctggtgcggtcgatttcgactttggcatccaacacctctccagccttgctcgcctcactgtcggcttattatgcgttggctcgacggcggcggaagtagaggctgcggaggatgctttcaagagcatggccgaggcgaaccccaaccgtccaatactggagatgacaagactttgtccgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctag

SEQ ID NO: 38 - protein, 942 aa, Triticum monococcum
MAEVLVSASTGAMGSLLRKLGAMLTDEYKLLKNVRGDIKFLKDELEVMCAFLLKMSDVEEPDEPTKLRVTAVREMSYKIEDNIDKFMVLVEHESSSSEAHGVTKLMDKCKNLLPDIKTRRRIAKEVKDIKKEIKDVSDRFLRYKIDDSSSSMPAAKDKVDPRLRAVYKDAAELVGIDGPKDELVKWLNEKEGQSLKSVSIVGYGGLGKTTLANQIRVNLGATFDCGAFVSISRKPDMKAILRSILSQITKKDEACPRLDDIQLIIDKIREFLQDTRYFIIIDDIWELGTWETLKCAFVKNTLGSRIIITTRIVDVAKSCSPSSEDLVYEMKPLSEADSKKLFFKRIFGCEESCPDSLKEAANDILKKCRGLPLAINAISSLLATTRETKEEWDRVRHSIRSSKVKSDIIETMNYILSLSYFDLPHHLRSCLLYLALFPEDQLIERKRLVRRWISEGFIHGESGQALMELGEEYFHQLVNRSLIQPGNIGYDGKAEYCRVHDTILDFLIDKSSEENMCTVLKKQCKPNGIVRRLSLMGNEDEEIMEQLDLSHARSISAFGDIKLLPSLGRSKCLRVLDLQGCYQLKNHHIKDIERLYQLRYLDISFTGITELPRQIGELLYLETLVTSYGLRELPESTSRLQRLARLFVYHGCKLPDGLGNLVNLQELECVDALQLKHVEELGKLTNLRKLSIKLDTGGIEGNKLEESKEKLVSSLCKLDECGLRSLSIHYYLREKDGEEPFLPALGCIQEVCVYGQDISRISRWLASLPNLHRLFFNDPKMKIEQQDIEMIGLIPNLMDLTLYLRITDDAMPRLIIKREGFQQLQRFELSRIRMGDLMFEPGAMPRLKELILHNFIEKPKSGAVDFDFGIQHLSSLARLTVGLLCVGSTAAEVEAAEDAFKSMAEANPNRPILEMTRLCPQHMLQDEQIGMTGSATTPAVKS

SEQ ID NO: 39 - DNA, 2826 bp, Triticum monococcum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctccagttccgaggctcatggcgtcaccaagctcatggacaagtgcaagaacttgctgccggatatcaagacccgccgcaggatcgccaaggaggtcaaagacatcaagaaagaaattaaggatgtcagcgacagatttttaaggtacaagattgacgactcctcctcctctatgcctgctgcaaaagacaaggtcgaccctcgacttcgtgcagtctacaaagacgccgcagagctcgtcggaattgatggaccaaaggatgaacttgtcaagtggctgaatgagaaagagggccaatcacttaaatctgtctctattgttggatatggagggttgggcaagaccacgctcgccaaccagatccgggtcaaccttggagcgactttcgactgcggggcttttgtctcgatttcacgcaagcctgacatgaaggcgatattaagatctatattatcgcaaatcaccaagaaagacgaggcttgccctagattagatgatatacaactcatcatcgacaagattcgagaattcctccaagacacaaggtactttatcataattgatgatatatgggagttaggaacatgggaaactttgaaatgtgcatttgtcaagaatacattgggcagcagaataattatcacaacacgtatagttgatgttgccaaatcttgctctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaagaaatgccgtggtctacctctggccatcaatgccatttctagcctgttggccacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattgaaaggaagcggttggtacgcagatggatttctgaaggctttatccatggagaaagtggacaagctctcatggaattaggagaggaatattttcaccagcttgtgaacagaagtctaatacagcccggcaacatagggtatgacggcaaggcggagtattgccgagtccatgacaccatccttgatttcctaattgacaaatcctctgaagagaacatgtgtactgtcctgaagaaacaatgcaagcctaatggcatagttcgtcggctctctctaatggggaatgaggatgaagaaatcatggagcaattggatctgtcacacgctcggtcaatcagtgcttttggggatatcaagctattgccttcgcttgggaggtcaaaatgcttgcgcgtgctagacttgcaaggctgctatcagttgaaaaatcatcatatcaaggatattgaaagactctatcagctgagatacttggatatctcttttacaggaatcacggagcttcccaggcaaattggggagttgctgtatctagagacgctagttacatcctatggattacgtgagcttcctgaaagcacaagtcggctacaacgactggcacgtttgtttgtttaccacggttgtaagcttccagatgggttgggaaacttggtaaacttgcaagagcttgagtgcgttgatgccttgcagttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctccgttccctgagtattcattattatctgagagaaaaggatggagaagagccgttcctccctgctttgggttgtatccaggaggtttgtgtatatggacaagatatcagccggattagcagatggctcgcgtcacttcccaacctacacaggttgtttttcaacgatcccaaaatgaagatagagcagcaggatattgagatgattggattgatacccaatctgatggatttgacactgtatttacgcataacagacgacgctatgccgaggctcatcatcaagcgtgaaggatttcaacagttgcagaggtttgagctttcccgtattcgtatgggggatttaatgtttgaaccgggggctatgccgaggctcaaggagcttatactccataacttcatcgaaaagcccaaatctggtgcggtcgatttcgactttggcatccaacacctctccagccttgctcgcctcactgtcggcttattatgcgttggctcgacggcggcggaagtagaggctgcggaggatgctttcaagagcatggccgaggcgaaccccaaccgtccaatactggagatgacaagactttgtccgcagcatatgttacaagacgagcaaataggtatgacaggctcagctacaacgccggccgtcaagtcc

SEQ ID NO: 40 - DNA, 5847 bp, Triticum aestivum
atggcggaagttctggtgagcgcatccacaggtgcaatgggttccctcctgcggaagttgggagctatgttgacggatgaatataagctgctcaagaatgtccgtggggacatcaagttcctcaaggacgagctggaggtcatgtgcgcattcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgttccgaggcggctcatggcgtcgccaagctcatggacaagtgcaagaacttgctgccggacatcaagacccgccgcaggatcgccaaggaggtcaaagacatcaagaaacaaattaaggatgtcagcgacagattttcaaggtaccagatctggttctctttacagtactattagtacctaccatcagatttgtgaccgatttgttgccactcaaggtacaagattgacgagtcctcctcctctatgcccgcaaaagagaaggtcgaccctcgacttcgtgcagtctacaaagatgtcacagagctcgtcggaattgacggaccaaaagatgaacttgtcaagtggctgaatgagaaagagggccaatcacttaaatctgtctctattgttggatatggagggttgggcaagaccacgctcgccaaccagatccgggtcaaccttagagcgtccttcgactgcggggcttttgtctcgatttcacgcaagcctgacatgaaggctatattaagatctatcttatcacaaatcaccaagaaagacgatgcttactctagattagatgatatacaactcatcatcgacaagattcgagaattcctccaagacacaaggtatgtatgtgagatctgctacaaactaacattgcttaattagctcatgtataatccgttgcctagaattttgctaatgaagattgctttgtgtgatttgcattcgccctcagcttgtatgactgcgtttaaaatttgaagtcattgttttctgcaactgatatcgatctgttcactataagatatagctaaaatctgcatgccgatttctggcgccacacatcttctaaggacccaaagcacttgcattcgcagaccactgttaccggatatatgcagtacattaggtttgtgattagccactttaagaacgtagggtttctagaggctataaacctacggttatcagtattataatcctgactggatatcaaacatccgttgaagaatctatacccataacacaaaaagttaaaagggaagaattaatcatagtcagatcggaccagcctgactagcgtaacataatgataaccgtagtttgttgcttctttcctggtttcgtagcaatttgcatgacgaattgaggcgcagacccaccactcaatatgtggtcctaccaatcatgaggaaataacttgttaccaaaaagacaaaagaaaataggtaatccccaccattgtttccatatctatcctcttgccaacatgctatttttttttgagcatcagtacagacacaagcgctcatatacacgtgcgtacactcacccctatgaacgcacacacgcataccctacccctatgagcacctccgagagtctgagtcgtcttgccaacatgctattggcagtggcaaaacattgtatcttgccactggcaacagctgcctcgactcggcctgagcatctcatcaaggaattcacaatttttcctcttggttgttaaatcttgctcttttttgtttgcctcctatggaaatgttttttcccttatattgcgaccaaattgtatctaagagcaactccaacgcgcctgacggagtttttgtccgctttttgtccgtttggatcggccgagcggacgggcatgtccggttttgccattgggtgcgtgggcgcgcccaatatggcctacgcattagtccgcatgggcattaaaaaaaattaaaagcttaaaataattaaacataaataaaaatgcatattaaaaccggtcaaagtccacataattaacataaaacattaataaataaactaccgccctagcccgcaaccctaggcatcgtcctcgtcgtcggagcgtgtgaaatcaaagaatgctggcggcccagaccacgggaaggccagctggtaggctaccaatgccgcctgctgcagcggtggctttgcctggcaccccgcgcgtctgctcctccacgcacgcccaacgaagccggcgctcctcctcctcgagctcccgctgcatgcggacctggctgtcctcccattcctcctccaacgtgtggttcttccatgccgcgaggtaggccgcctcctccgtcgcgcccagccaaacggtcagcgcgctcacccactcccggacgacgtcctgccattggtagacgctggtgggcgcgggtggtgccgacgctggcgcgggcggttacgatggggccggtggtggtggcaggtagacgttgtcgctcgcagccgacaactgcagtgcgtcctcgaggccaggccaccaggagtccccgggctgggactcctcaatggcgcgctgggtcgcctcctccaacgcctcgaggaacgccgcctcttcctcctcaccctactgcttgaccaccggcggtggcagtggagggcgtgcttcgagctggacggcgccgtggcggcacacatcgtgctcggtggtgaaccggacgtcccagttaggggagtctagcgtgtaggcggggtcgcagaactgctccgacgtcaggagagcacacccgtctcggatcttcttggctcgcggacgttcaaaccacgccacggacgacaccgaaatgcggtgggggtcgaggtgccagccgtgggggaggttcacgtccagccacgacagtgggacgcggtactcctagtggtactgcacggtcccgtggcgctgtcgccctcccgtcccatgacgccgacaccaatgcgcaccccttcgtcggcggcctcaccggtccttgcgctgagccagcctcgtggtcgtgcttccccttgcccttgcctttgccgaagatacccatgatgactagggttttctgtcgtcggtgagggagcagatgtggactggagtgggaggagaagtggataaggccggccccgccgcaccattgcaattaaaaaggatgcgatttggacacttctagtcactgccatgcgggcccgaggtaggtgggctgcattgactatgactgcggtggtagttgatagtcgacacgcgggcatgaggcggacgcgcagcacgtccatctcgtgttcgtgtggacgcaaatcaggtgcaaatttgggttggaaatgtgtcacatggacaccgagcggacgtggtttgggtttgtgtccgcgtgttgggctggcgttttgtccatttcgactcaaacggacacgcgcggaccaaatgcgccggcgcgttggagttgcttgtacctagtactatgtgtggagttgttatctttgagtttcttcccaatttgtagttgtgtattattgtgagatgctctgaggatttcacttatcgtacaagtatgttttagataatgacatctttattgatgttagacaattacatcaaggtgtattatatctaggatgcacacagatgtgacattgtttcgggattttacgttacttgataggtattactataaatatctaatgagctctaatgcgtatattcataaaactgtgttgcaggtacttcatcataattgatgatatatgggagttaggaacatgggaaactttgaaatgtgcatttgtcaagaatacattgggcagcagaataattatcacaacacgtatagttgatgttgccaaatcttgctctccttctagtgaagatcttgtctatgagatgaaaccactcagtgaggctgactcaaagaaattgtttttcaagaggatatttggctgtgaagaaagctgtcctgatagcttgaaagaagctgccaatgatattttgaaaaaatgccgtggtctacctctggccatcaatgccatttctagcttgttggccacaacaagggaaacaaaagaagagtgggatcgggtgcgacattcaatacactcttcaaaggtcaaaagtgatataatagagaccatgaattacatattatctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtaaacagaagtctaatacagcccgactacatagggtatgacggcaagacggagtattgccgagtccatgacaccatccttgatttcctaattgacaaatcctccgaagagaacatgtgtaccgtcctaaagaaacaatgcaagcctaatggcatagttcgtcggctctctctaatggggaatgaggatgaagaaatcgtggagcaattggatctgtcacacgctcggtcaatcagtgcttttggggatatcaagctattgccttcgcttgggaggtcaaaatgcttgcgcgtgctagacttgcaaaactgcggtcagttgagaaatcatcatatcaaggacattgaaagactctatcagctgagatacttggatatctcttttacaggaatcacggagcttcccaggcaaattggggagttgctgtatctagagacgctagttacatccgatggattacgtgagcttcctgaaagcacaagtcggctacaacgactggcacgtttgattgttggctgcgattgtaagcttccagatgggttgggaaacttgatgaacttgcaagagcttgactgcgttggtgccttgcatttgaagcatgcggaagagctcggcaaactaacaaatctgagaaagctgaagattaacttgtacactcatgggattgaaggcaacaaattagaagagtccaaggaaaagctggtgtcctctctctgtaaactggacgaatgcggcctccgttccctgagtattgattattatctgagagaaaaggatggagaagagccgttcctccctgctttaggttgtatcgaggaggtttttgtatatgaacaagatatcagccggattagcagatggctcgcgtcacttcccaacctacacaggttggtttcctacgatccgaagatagagcagcaggatattgagatgattggattgatacccaatctgatcgatttgacactgtctttaccgggaacagacgacgctgggcggttcatcatcacgcgtgaaggatttcaacagttgcagagttttgagctttccggtagtcgtatgggagttttatttgaaccgggggctatgccgaggctcaaggagcttatactcgacgacttcatcagaaagcccaaatctgctgcggtcgatttcgactttggcatccaacgcctctccagccttgctcgcctcactgtcagcttagcctgctatcgctcgacggcggcagaagtagaggctacggaggatgctttcaagagcatggccgaggcgaaccccaaccgtccaatactggagatgacaagactttatccgcagcatatggtacgagacgagcaaatagatatggcaggctcaggtactattaacaagtttgtactttttgtcttggtgagcagtagatcaaaagatgtgcatatgcttaattctttttccggtcatctatttcagctacaacgccggccgtcaagtcctag

SEQ ID NO: 41 - protein, 938 aa, Triticum aestivum
MAEVLVSASTGAMGSLLRKLGAMLTDEYKLLKNVRGDIKFLKDELEVMCAFLLKMSDVEEPDEPTKLRVTAVREMSYKIEDNIDKFMVLVEHESSCSEAAHGVAKLMDKCKNLLPDIKTRRRIAKEVKDIKKQIKDVSDRFSRYKIDESSSSMPAKEKVDPRLRAVYKDVTELVGIDGPKDELVKWLNEKEGQSLKSVSIVGYGGLGKTTLANQIRVNLRASFDCGAFVSISRKPDMKAILRSILSQITKKDDAYSRLDDIQLIIDKIREFLQDTRYFIIIDDIWELGTWETLKCAFVKNTLGSRIIITTRIVDVAKSCSPSSEDLVYEMKPLSEADSKKLFFKRIFGCEESCPDSLKEAANDILKKCRGLPLAINAISSLLATTRETKEEWDRVRHSIHSSKVKSDIIETMNYILSLSYFDLPHHLRSCLLYLALFPEDQLIGRKRLVRRWISEGFIHGESGQDLMELGEEYFHQLVNRSLIQPDYIGYDGKTEYCRVHDTILDFLIDKSSEENMCTVLKKQCKPNGIVRRLSLMGNEDEEIVEQLDLSHARSISAFGDIKLLPSLGRSKCLRVLDLQNCGQLRNHHIKDIERLYQLRYLDISFTGITELPRQIGELLYLETLVTSDGLRELPESTSRLQRLARLIVGCDCKLPDGLGNLMNLQELDCVGALHLKHAEELGKLTNLRKLKINLYTHGIEGNKLEESKEKLVSSLCKLDECGLRSLSIDYYLREKDGEEPFLPALGCIEEVFVYEQDISRISRWLASLPNLHRLVSYDPKIEQQDIEMIGLIPNLIDLTLSLPGTDDAGRFIITREGFQQLQSFELSGSRMGVLFEPGAMPRLKELILDDFIRKPKSAAVDFDFGIQRLSSLARLTVSLACYRSTAAEVEATEDAFKSMAEANPNRPILEMTRLYPQHMVRDEQIDMAGSATTPAVKS

SEQ ID NO: 42 - DNA, 2814 bp, Triticum aestivum
atggcggaagttctggtgagcgcatccacaggtgcaatgggttccctcctgcggaagttgggagctatgttgacggatgaatataagctgctcaagaatgtccgtggggacatcaagttcctcaaggacgagctggaggtcatgtgcgcattcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgttccgaggcggctcatggcgtcgccaagctcatggacaagtgcaagaacttgctgccggacatcaagacccgccgcaggatcgccaaggaggtcaaagacatcaagaaacaaattaaggatgtcagcgacagattttcaaggtacaagattgacgagtcctcctcctctatgcccgcaaaagagaaggtcgaccctcgacttcgtgcagtctacaaagatgtcacagagctcgtcggaattgacggaccaaaagatgaacttgtcaagtggctgaatgagaaagagggccaatcacttaaatctgtctctattgttggatatggagggttgggcaagaccacgctcgccaaccagatccgggtcaaccttagagcgtccttcgactgcggggcttttgtctcgatttcacgcaagcctgacatgaaggctatattaagatctatcttatcacaaatcaccaagaaagacgatgcttactctagattagatgatatacaactcatcatcgacaagattcgagaattcctccaagacacaaggtacttcatcataattgatgatatatgggagttaggaacatgggaaactttgaaatgtgcatttgtcaagaatacattgggcagcagaataattatcacaacacgtatagttgatgttgccaaatcttgctctccttctagtgaagatcttgtctatgagatgaaaccactcagtgaggctgactcaaagaaattgtttttcaagaggatatttggctgtgaagaaagctgtcctgatagcttgaaagaagctgccaatgatattttgaaaaaatgccgtggtctacctctggccatcaatgccatttctagcttgttggccacaacaagggaaacaaaagaagagtgggatcgggtgcgacattcaatacactcttcaaaggtcaaaagtgatataatagagaccatgaattacatattatctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtaaacagaagtctaatacagcccgactacatagggtatgacggcaagacggagtattgccgagtccatgacaccatccttgatttcctaattgacaaatcctccgaagagaacatgtgtaccgtcctaaagaaacaatgcaagcctaatggcatagttcgtcggctctctctaatggggaatgaggatgaagaaatcgtggagcaattggatctgtcacacgctcggtcaatcagtgcttttggggatatcaagctattgccttcgcttgggaggtcaaaatgcttgcgcgtgctagacttgcaaaactgcggtcagttgagaaatcatcatatcaaggacattgaaagactctatcagctgagatacttggatatctcttttacaggaatcacggagcttcccaggcaaattggggagttgctgtatctagagacgctagttacatccgatggattacgtgagcttcctgaaagcacaagtcggctacaacgactggcacgtttgattgttggctgcgattgtaagcttccagatgggttgggaaacttgatgaacttgcaagagcttgactgcgttggtgccttgcatttgaagcatgcggaagagctcggcaaactaacaaatctgagaaagctgaagattaacttgtacactcatgggattgaaggcaacaaattagaagagtccaaggaaaagctggtgtcctctctctgtaaactggacgaatgcggcctccgttccctgagtattgattattatctgagagaaaaggatggagaagagccgttcctccctgctttaggttgtatcgaggaggtttttgtatatgaacaagatatcagccggattagcagatggctcgcgtcacttcccaacctacacaggttggtttcctacgatccgaagatagagcagcaggatattgagatgattggattgatacccaatctgatcgatttgacactgtctttaccgggaacagacgacgctgggcggttcatcatcacgcgtgaaggatttcaacagttgcagagttttgagctttccggtagtcgtatgggagttttatttgaaccgggggctatgccgaggctcaaggagcttatactcgacgacttcatcagaaagcccaaatctgctgcggtcgatttcgactttggcatccaacgcctctccagccttgctcgcctcactgtcagcttagcctgctatcgctcgacggcggcagaagtagaggctacggaggatgctttcaagagcatggccgaggcgaaccccaaccgtccaatactggagatgacaagactttatccgcagcatatggtacgagacgagcaaatagatatggcaggctcagctacaacgccggccgtcaagtcc

SEQ ID NO: 43 - DNA, 5918 bp, Triticum aestivum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgactctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctag

SEQ ID NO: 44 - DNA, 5918 bp, Triticum aestivum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgagatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctag

SEQ ID NO: 45 - DNA, 5918 bp, Triticum aestivum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatttcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctag

SEQ ID NO: 46 - DNA, 5918 bp, Triticum aestivum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaaaactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctag

SEQ ID NO: 47 - DNA, 5918 bp, Triticum aestivum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattgaggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctag

SEQ ID NO: 48 - DNA, 5918 bp, Triticum aestivum
atggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagtaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctag

SEQ ID NO: 49 - DNA, 6564 bp, Aegilops tauschii
aatgatgggcaggcgacgcgagtgtgtttaagaaaaaaaaaagcctcatcaaatatgagttttttaggggatctgggaatatgagtactgtaataattgattccgtcgcgcctctgcgtccaccgcccaacagcccaaatcgccgccgcctcgctcttccctactccggccaccgccgccgccgacggccacgctccgctgtttccccccaccccacccctccagcaccatgcctctgttcctcgttgccacatcggtaacctgccccacaggcggccccaccgtgctgctgtggggtggccgtcgatgtcgccggcagggtcctcccgcgtgcttctccaagcgacctctgccagctcctcccttgtctcgcgtcgcctgccatgcgtggctcggacccaaaatcttttcgcccgttcgcggagccgggtagggaggggggcggagatgctctgaacttgaagccgagatatttggagtgcagcagatggactcatttttctaagagcgcacatgctatatatcagcggtaaatttcctcatacattgttgctaacggagcaagatttgtagccaaacgaagatttgttttcctggtaacgaaggattctgtattgtttcacctacccataacaaaaagataacgcatttctgtatggcagggctgcgtggtggtcgttgaagtcgccggccccgctgtcccatttttttccacacgccatcgtccacttgctctgaatctgcctaactccagaccatttcttccacacgttgctcttatccttttgcgcgtgcttccgcgcggtctcatcctgttgacctgctaaatctgcacaactacatgccatttctcttctgcatagatctcacgctctcatccaggtttcctggatctgcacagctgcaggccatttctcttctgcatagcgcttgtagtgtttccctgtgtttgcagtgtgagagctaaaatggcggagtttgtagtcaggccactggtatccacgttgatgaacacggcatccagctacctgctggaccagtacaaggtgatggatggcatgaaggagcagcgcgagaccctcaagcgccagctgccagccatcttggacatcatccaagatgcggagaagaaaggagcttccctacctggagtgcgcgcttggctcgaagcactcaagaaggtggcctatgaggcgaacgatgtctttgatgagttcaagtacgaggccctccggcgtgacgccaagaagaagggacactacaagaagcttggctttgacatcgtaagcctcttccctgctcacaaccccattgtatttcgttacaggatgggcaagaagttgtgcaggattgtgcgcaaaattgagggccttgtcagagagatgaatgacttcggattcaaccaaactcagcaagcaccaccatccaagcagtggcgcaacacagattccataataattgactctgagaaggatattgtcagcaggtccagaaacgaagagaagaagaagatcgttgatatattgattgatcaagctggcgatagggacctcatcgtccttcccattgttggaatgggcgggctgggcaagaccacctttgctcagcttgtctacaatgaccctataatcaaggagcatttcaagctccagaggtggtgttgtgtgtcagatgattttgatgttgtgaagattgcaaacaacatctgtgagaccaatgagatccatcgtgaaaaggcattgcagaaccttcagaaagaagtaagtgggaagagatacctcattgtgttggatgatgtatggaatgaagatgctgataagtgggaaaaactgaaaacctgcctgaagcacggtgggaaggggagtgcaatattgacgaccactcgcaatgtgcaagtagcacgaattatgaagatgtgtattgctgatagccataatctcagaaatctagataaagtatttctgaaggaaatatttgagaatagagcattctgtttgcaaaagccaaaggctgctgagctaagcgatgtggttgataagattatggacagatgtggaggctctcctttagctgccaaagcctttgggtctatgttgagtaacaagactagcatgaaagaatggacagacatactagccagaagcaacacttgcaatgagggcacaaaaacttttcttgtactcaagctcagctatgatgacttgccatcacacttgaaacaatgctttgctttttgtgctgtatttcccaaagattatgagattggtgttgaaacattaattcagctatggatggcacatgatttcataccactgaaagaaggtgataatcttgagaaggtaggtagagaaatttttgatgagttaacttggaggtcattctttcaagatgtcaagcgaatccctcgaagagagtggtggggggagctccgtcctagaacaatatgcaagatacatgatcttatgcatgacattgccttgtctgttatgggaaaagattgtcttactatagttgataggcctaatgaaaaggagttactgtccactggtcctacacgttacttgttctcatcatatgagtatatcggaactctgttggatgattatctgaagaaacactctcccgctctccagacactgctgtatccgtatccctacaccagtgactcagcaccacacttgtcgaagtgcaattatctgcgagcactgcaactcttcagtttgagaaaacttccactctggccaaggcacttacagcacctgaggtatcttgatctctcaaataacatgttgatcgaagagcttcccaaggaaataagcatactgtataatctacagactcttaacctttgtaactgcagaaggcttgatcaacttccagaggatatgaagtatatggaaaatctccgtcacctctatacaaatggatgctcatcattgaagtgcatgcctccaggcctcgggcaactcacttctctacagactctaacatattttgtggtgagctctagtcctggttgcagtactattagagaactacaggacttgaatcttggtggtgagttagagctatctcgtcttcagtttgcaactgaagtagatgctaaagcatgcagccttggaaataaagagaaacttacacatttatctcttaaatggggtgatgacagcagtgatgaattgggccaccacaggaatgtgctcgatgctcttaaacctcatgctgtcctggagtttctaagaatacgctcctatagaggtactggcttccccgcatgggtggtaagtattaattttctgcagcatttgaccgagctccagctagatggttgtacaatgtgtgaggaatttccccaattcggtcaatttaagtcccttgaagttcttgttttgaaaaggttgaacaaacttcaaagcctatgcaatcacagttcatctgcaatatttccagcattaaaagttctcagattaaaaaaattggagatttttgagagatgggtggcaacagaaggagaagagttagcatttcctcaacttgagaatgttaaaattaaggactgcccaaagctagcaattctgcctgaagcaccaaaactcaagtttatagctctaaaagaagaaaaggcacagctatccttatcaatatttaagtccaggtatatggcttgcttgtctggggttggcctgtccgtccgtgatacagaagcagcaccaagaacagagcttgatcaggattgtgaagtatctctttcgaacctgctgttggatggttgcaactttttgttctgctcaactccattgcagccaactgttggggtctggaaatggtttggtcagcttgtgcatttggaaataaaatcttgtgatatgctcatctactggcctgaagaagagttccgttgcttggtatcattgaatagtttatccattaattcctgcagcaagctagtaggacacacccaggggaaaggatgccgtacccgtactcaagtaagggatcaactcctgccaaatcttaaaaatttaagaatacatcattgtggaagtttgacagagctttttgttctgccgccatctctcacaagtattgatatgctggattgcaatagtattgagtccatactggggcaggatgatacagagttggagagtatactacactttgatacagcatcatcatcggaacacttcaatgacctcacgtccacatgtttgctagagcagtcactttcacccagaattaatcctttgccatgtcttgattatttgcgtatagttagctgtaagaagcttcgtttcgtgccagtgcagttagatgcactccaatttttgtgtatttctgattgcaatgggctggagtcgctggattgtttgggagacctaccgtcactggaatatctataccttatgggctgcaaacatctggcatctgtaccaggaagtcttgggagttactcggcccttcagaagctccgcattgaatactgcccagctttaaatatgaagccacttcatggacatctccaacagcggcttgatagccttgaattgaaggatctatctaaggctggttcaagccatcctaatgaaggtacctttcaatttcatttaccccattttgtatctctttttccatctgtatagtttacagatgtacatattgcagcctgtagtttcaagtttatccaactccttgtattttcacatttggtatgtagtgaccgcgtacacagtttctctgatatggctattccaatatcatttatttgtataccgtaagtttgacttggattgacgtcgtcatgtgtggccgatctgtattttctatcattttggtaaaagttaatacaccatggaagtatgctctcttgtgtagtgaccgtacacagatcattcttttatgtctatcccactatcatttatttgtaaagtttgacttgctattaatgttcacagagatattctgacattgttttccatgtacagggcctaaactatgggaaccaaaatcctggaaatatatgattccttcactgcgcaagcgtgagtctgaatagagatacaactaccatgtatgtttctggtttttttttcttgcaactttgattctaaaagtttgtaggctaaaagatcggttttggtatgttcaccattcttgacctgaatgtgtttaatttccttgcagggtcgctcgtgtgcgcatacaagtgatgaacacaattggtaactgccctcttcaagggagtcaagttcttttatttgcctgctccgtgagctctgatgaaaataaggcgctcgaaggcctgaagcatgggggaaaatgaacttcaacttgcagaactggagagagaaggtcgtgctgaatcgtgtttactttgtgcagaacaaacaagcatgtccttgggcaaatcgtgcggactataagtgcacttgcagtcgtgtgctggcgatcgagccttttgttttccatgtgtacttacagttcaccgtagtaatacggtgtgctatttcacatcttttacataatctttagagcagagcacgatcctggttaattcagacagctgattagcagacatctggttagttcagagttagagattgtgtgcgtgtgtttatggctgcttcagagagctgattgtgtgcgtgtttttgtgcgtgcacgacgtgctagtatctgcttgccaattcgccatgtacacaaaagtctgcaaccaaacttggaagatctcaaattaccagtgcctttcaggatgaacatacagtacatgatttcagaagagtagagtgcaggtgccagcttccaccattttgttctgccgcaaaccagagctgatcgcagcaaagaaattatatagacagccatggtagtatagtaagctcactctagttcttcagttccagcaggcacacatgtcctctcaacagaacagaacagaagggaacagccccacaccgcaggctgttgtcaccgactcaccgtgcacaaacctgcttccgtccattttacgacggtccgtcgcttgccatctctagcttcccttttttttgatagaaagaccgtaatggaaccccctacagtataattggtgcaacaaatccaaattgcaagtaccataccttgaatctgggtgggtgggaaggcatcaacccctccccatcactaggctatgccttagtctgccatctctagcttccctaccgaccagggaatcacggctcgtgctaccccttttagcaccccgacgaggagtagcttctgcacggattatagtggggaagaaaatgtatgactaggatacaggaattccagagaagccaaattcaggaaacaaccaatccctttattttacaaagccgcccataaacctttttttaataaaacatggtagtacggggattttattttaataaacaaccaatccccttcttttacctggtattatgattttatccattccccaataaccaacataatttcttctaccaaaaaaacaacccttggtgatgaatttattcagcataatgagaagaacatgtataactgcaatgcagcaggaatttc

SEQ ID NO: 50 - protein, 1230 aa, Aegilops tauschii
  DOMAIN (32)..(55): coiled-coil domain
  DOMAIN (175)..(452): nucleotide binding domain
  DOMAIN (578)..(867): leucine-rich repeat domain
MAEFVVRPLVSTLMNTASSYLLDQYKVMDGMKEQRETLKRQLPAILDIIQDAEKKGASLPGVRAWLEALKKVAYEANDVFDEFKYEALRRDAKKKGHYKKLGFDIVSLFPAHNPIVFRYRMGKKLCRIVRKIEGLVREMNDFGFNQTQQAPPSKQWRNTDSIIIDSEKDIVSRSRNEEKKKIVDILIDQAGDRDLIVLPIVGMGGLGKTTFAQLVYNDPIIKEHFKLQRWCCVSDDFDVVKIANNICETNEIHREKALQNLQKEVSGKRYLIVLDDVWNEDADKWEKLKTCLKHGGKGSAILTTTRNVQVARIMKMCIADSHNLRNLDKVFLKEIFENRAFCLQKPKAAELSDVVDKIMDRCGGSPLAAKAFGSMLSNKTSMKEWTDILARSNTCNEGTKTFLVLKLSYDDLPSHLKQCFAFCAVFPKDYEIGVETLIQLWMAHDFIPLKEGDNLEKVGREIFDELTWRSFFQDVKRIPRREWWGELRPRTICKIHDLMHDIALSVMGKDCLTIVDRPNEKELLSTGPTRYLFSSYEYIGTLLDDYLKKHSPALQTLLYPYPYTSDSAPHLSKCNYLRALQLFSLRKLPLWPRHLQHLRYLDLSNNMLIEELPKEISILYNLQTLNLCNCRRLDQLPEDMKYMENLRHLYTNGCSSLKCMPPGLGQLTSLQTLTYFVVSSSPGCSTIRELQDLNLGGELELSRLQFATEVDAKACSLGNKEKLTHLSLKWGDDSSDELGHHRNVLDALKPHAVLEFLRIRSYRGTGFPAWVVSINFLQHLTELQLDGCTMCEEFPQFGQFKSLEVLVLKRLNKLQSLCNHSSSAIFPALKVLRLKKLEIFERWVATEGEELAFPQLENVKIKDCPKLAILPEAPKLKFIALKEEKAQLSLSIFKSRYMACLSGVGLSVRDTEAAPRTELDQDCEVSLSNLLLDGCNFLFCSTPLQPTVGVWKWFGQLVHLEIKSCDMLIYWPEEEFRCLVSLNSLSINSCSKLVGHTQGKGCRTRTQVRDQLLPNLKNLRIHHCGSLTELFVLPPSLTSIDMLDCNSIESILGQDDTELESILHFDTASSSEHFNDLTSTCLLEQSLSPRINPLPCLDYLRIVSCKKLRFVPVQLDALQFLCISDCNGLESLDCLGDLPSLEYLYLMGCKHLASVPGSLGSYSALQKLRIEYCPALNMKPLHGHLQQRLDSLELKDLSKAGSSHPNEGPKLWEPKSWKYMIPSLRKRESE

SEQ ID NO: 51 - DNA, 3690 bp, Aegilops tauschii
atggcggagtttgtagtcaggccactggtatccacgttgatgaacacggcatccagctacctgctggaccagtacaaggtgatggatggcatgaaggagcagcgcgagaccctcaagcgccagctgccagccatcttggacatcatccaagatgcggagaagaaaggagcttccctacctggagtgcgcgcttggctcgaagcactcaagaaggtggcctatgaggcgaacgatgtctttgatgagttcaagtacgaggccctccggcgtgacgccaagaagaagggacactacaagaagcttggctttgacatcgtaagcctcttccctgctcacaaccccattgtatttcgttacaggatgggcaagaagttgtgcaggattgtgcgcaaaattgagggccttgtcagagagatgaatgacttcggattcaaccaaactcagcaagcaccaccatccaagcagtggcgcaacacagattccataataattgactctgagaaggatattgtcagcaggtccagaaacgaagagaagaagaagatcgttgatatattgattgatcaagctggcgatagggacctcatcgtccttcccattgttggaatgggcgggctgggcaagaccacctttgctcagcttgtctacaatgaccctataatcaaggagcatttcaagctccagaggtggtgttgtgtgtcagatgattttgatgttgtgaagattgcaaacaacatctgtgagaccaatgagatccatcgtgaaaaggcattgcagaaccttcagaaagaagtaagtgggaagagatacctcattgtgttggatgatgtatggaatgaagatgctgataagtgggaaaaactgaaaacctgcctgaagcacggtgggaaggggagtgcaatattgacgaccactcgcaatgtgcaagtagcacgaattatgaagatgtgtattgctgatagccataatctcagaaatctagataaagtatttctgaaggaaatatttgagaatagagcattctgtttgcaaaagccaaaggctgctgagctaagcgatgtggttgataagattatggacagatgtggaggctctcctttagctgccaaagcctttgggtctatgttgagtaacaagactagcatgaaagaatggacagacatactagccagaagcaacacttgcaatgagggcacaaaaacttttcttgtactcaagctcagctatgatgacttgccatcacacttgaaacaatgctttgctttttgtgctgtatttcccaaagattatgagattggtgttgaaacattaattcagctatggatggcacatgatttcataccactgaaagaaggtgataatcttgagaaggtaggtagagaaatttttgatgagttaacttggaggtcattctttcaagatgtcaagcgaatccctcgaagagagtggtggggggagctccgtcctagaacaatatgcaagatacatgatcttatgcatgacattgccttgtctgttatgggaaaagattgtcttactatagttgataggcctaatgaaaaggagttactgtccactggtcctacacgttacttgttctcatcatatgagtatatcggaactctgttggatgattatctgaagaaacactctcccgctctccagacactgctgtatccgtatccctacaccagtgactcagcaccacacttgtcgaagtgcaattatctgcgagcactgcaactcttcagtttgagaaaacttccactctggccaaggcacttacagcacctgaggtatcttgatctctcaaataacatgttgatcgaagagcttcccaaggaaataagcatactgtataatctacagactcttaacctttgtaactgcagaaggcttgatcaacttccagaggatatgaagtatatggaaaatctccgtcacctctatacaaatggatgctcatcattgaagtgcatgcctccaggcctcgggcaactcacttctctacagactctaacatattttgtggtgagctctagtcctggttgcagtactattagagaactacaggacttgaatcttggtggtgagttagagctatctcgtcttcagtttgcaactgaagtagatgctaaagcatgcagccttggaaataaagagaaacttacacatttatctcttaaatggggtgatgacagcagtgatgaattgggccaccacaggaatgtgctcgatgctcttaaacctcatgctgtcctggagtttctaagaatacgctcctatagaggtactggcttccccgcatgggtggtaagtattaattttctgcagcatttgaccgagctccagctagatggttgtacaatgtgtgaggaatttccccaattcggtcaatttaagtcccttgaagttcttgttttgaaaaggttgaacaaacttcaaagcctatgcaatcacagttcatctgcaatatttccagcattaaaagttctcagattaaaaaaattggagatttttgagagatgggtggcaacagaaggagaagagttagcatttcctcaacttgagaatgttaaaattaaggactgcccaaagctagcaattctgcctgaagcaccaaaactcaagtttatagctctaaaagaagaaaaggcacagctatccttatcaatatttaagtccaggtatatggcttgcttgtctggggttggcctgtccgtccgtgatacagaagcagcaccaagaacagagcttgatcaggattgtgaagtatctctttcgaacctgctgttggatggttgcaactttttgttctgctcaactccattgcagccaactgttggggtctggaaatggtttggtcagcttgtgcatttggaaataaaatcttgtgatatgctcatctactggcctgaagaagagttccgttgcttggtatcattgaatagtttatccattaattcctgcagcaagctagtaggacacacccaggggaaaggatgccgtacccgtactcaagtaagggatcaactcctgccaaatcttaaaaatttaagaatacatcattgtggaagtttgacagagctttttgttctgccgccatctctcacaagtattgatatgctggattgcaatagtattgagtccatactggggcaggatgatacagagttggagagtatactacactttgatacagcatcatcatcggaacacttcaatgacctcacgtccacatgtttgctagagcagtcactttcacccagaattaatcctttgccatgtcttgattatttgcgtatagttagctgtaagaagcttcgtttcgtgccagtgcagttagatgcactccaatttttgtgtatttctgattgcaatgggctggagtcgctggattgtttgggagacctaccgtcactggaatatctataccttatgggctgcaaacatctggcatctgtaccaggaagtcttgggagttactcggcccttcagaagctccgcattgaatactgcccagctttaaatatgaagccacttcatggacatctccaacagcggcttgatagccttgaattgaaggatctatctaaggctggttcaagccatcctaatgaagggcctaaactatgggaaccaaaatcctggaaatatatgattccttcactgcgcaagcgtgagtctgaa

SEQ ID NO: 52 - DNA, 4088 bp, Triticum aestivum
atggcggagtttgtagtcaggccactggtatccacgttgatgaacacggcatccagctacctgctggaccagtacaaggtgatggatggcatgaaggagcagcgcgagaccctcaagcgccagctgccagccatcttggacatcatccaagatgcggagaagaaaggagcttccctacctggagtgcgcgcttggctcgaagcactcaagaaggtggcctatgaggcgaacgatgtctttgatgagttcaagtacgaggccctccggcgtgacgccaagaagaagggacactacaagaagcttggctttgacatcgtaagcctcttccctgctcacaaccccattgtatttcgttacaggatgggcaagaagttgtgcaggattgtgcgcaaaattgagggccttgtcagagagatgaatgacttcggattcaaccaaactcagcaagcaccaccatccaagcagtgacgcaacacagattccataataattgactctgagaaggatattgtcagcaggtccagaaacgaagagaagaagaagatcgttgatatattgattgatcaagctggcgatagggacctcatcgtccttcccattgttggaatgggcgggctgggcaagaccacctttgctcagcttgtctacaatgaccctataatcaaggagcatttcaagctccagaggtggtgttgtgtgtcagatgattttgatgttgtgaagattgcaaacaacatctgtgagaccaatgagatccatcgtgaaaaggcattgcagaaccttcagaaagaagtaagtgggaagagatacctcattgtgttggatgatgtatggaatgaagatgctgataagtgggaaaaactgaaaacctgcctgaagcacggtgggaaggggagtgcaatattgacgaccactcgcaatgtgcaagtagcacgaattatgaagatgtgtattgctgatagccataatctcagaaatctagataaagtatttctgaaggaaatatttgagaatagagcattctgtttgcaaaagccaaaggctgctgagctaagcgatgtggttgataagattatggacagatgtggaggctctcctttagctgccaaagcctttgggtctatgttgagtaacaagactagcatgaaagaatggacagacatactagccagaagcaacacttgcaatgagggcacaaaaacttttcttgtactcaagctcagctatgatgacttgccatcacacttgaaacaatgctttgctttttgtgctgtatttcccaaagattatgagattggtgttgaaacattaattcagctatggatggcacatgatttcataccactgaaagaaggtgataatcttgagaaggtaggtagagaaatttttgatgagttaacttggaggtcattctttcaagatgtcaagcgaatccctcgaagagagtggtggggggagctccgtcctagaacaatatgcaagatacatgatcttatgcatgacattgccttgtctgttatgggaaaagattgtcttactatagttgataggcctaatgaaaaggagttactgtccactggtcctacacgttacttgttctcatcatatgagtatatcggaactctgttggatgattatctgaagaaacactctcccgctctccagacactgctgtatccgtatccctacaccagtgactcagcaccacacttgtcgaagtgcaattatctgcgagcactgcaactcttcagtttgagaaaacttccactctggccaaggcacttacagcacctgaggtatcttgatctctcaaataacatgttgatcgaagagcttcccaaggaaataagcatactgtataatctacagactcttaacctttgtaactgcagaaggcttgatcaacttccagaggatatgaagtatatggaaaatctccgtcacctctatacaaatggatgctcatcattgaagtgcatgcctccaggcctcgggcaactcacttctctacagactctaacatattttgtggtgagctctagtcctggttgcagtactattagagaactacaggacttgaatcttggtggtgagttagagctatctcgtcttcagtttgcaactgaagtagatgctaaagcatgcagccttggaaataaagagaaacttacacatttatctcttaaatggggtgatgacagcagtgatgaattgggccaccacaggaatgtgctcgatgctcttaaacctcatgctgtcctggagtttctaagaatacgctcctatagaggtactggcttccccgcatgggtggtaagtattaattttctgcagcatttgaccgagctccagctagatggttgtacaatgtgtgaggaatttccccaattcggtcaatttaagtcccttgaagttcttgttttgaaaaggttgaacaaacttcaaagcctatgcaatcacagttcatctgcaatatttccagcattaaaagttctcagattaaaaaaattggagatttttgagagatgggtggcaacagaaggagaagagttagcatttcctcaacttgagaatgttaaaattaaggactgcccaaagctagcaattctgcctgaagcaccaaaactcaagtttatagctctaaaagaagaaaaggcacagctatccttatcaatatttaagtccaggtatatggcttgcttgtctggggttggcctgtccgtccgtgatacagaagcagcaccaagaacagagcttgatcaggattgtgaagtatctctttcgaacctgctgttggatggttgcaactttttgttctgctcaactccattgcagccaactgttggggtctggaaatggtttggtcagcttgtgcatttggaaataaaatcttgtgatatgctcatctactggcctgaagaagagttccgttgcttggtatcattgaatagtttatccattaattcctgcagcaagctagtaggacacacccaggggaaaggatgccgtacccgtactcaagtaagggatcaactcctgccaaatcttaaaaatttaagaatacatcattgtggaagtttgacagagctttttgttctgccgccatctctcacaagtattgatatgctggattgcaatagtattgagtccatactggggcaggatgatacagagttggagagtatactacactttgatacagcatcatcatcggaacacttcaatgacctcacgtccacatgtttgctagagcagtcactttcacccagaattaatcctttgccatgtcttgattatttgcgtatagttagctgtaagaagcttcgtttcgtgccagtgcagttagatgcactccaatttttgtgtatttctgattgcaatgggctggagtcgctggattgtttgggagacctaccgtcactggaatatctataccttatgggctgcaaacatctggcatctgtaccaggaagtcttgggagttactcggcccttcagaagctccgcattgaatactgcccagctttaaatatgaagccacttcatggacatctccaacagcggcttgatagccttgaattgaaggatctatctaaggctggttcaagccatcctaatgaaggtacctttcaatttcatttaccccattttgtatctctttttccatctgtatagtttacagatgtacatattgcagcctgtagtttcaagtttatccaactccttgtattttcacatttggtatgtagtgaccgcgtacacagtttctctgatatggctattccaatatcatttatttgtataccgtaagtttgacttggattgacgtcgtcatgtgtggccgatctgtattttctatcattttggtaaaagttaatacaccatggaagtatgctctcttgtgtagtgaccgtacacagatcattcttttatgtctatcccactatcatttatttgtaaagtttgacttgctattaatgttcacagagatattctgacattgttttccatgtacagggcctaaactatgggaaccaaaatcctggaaatatatgattccttcactgcgcaagcgtgagtctgaatag

SEQ ID NO: 53 - DNA, 4088 bp, Triticum aestivum
atggcggagtttgtagtcaggccactggtatccacgttgatgaacacggcatccagctacctgctggaccagtacaaggtgatggatggcatgaaggagcagcgcgagaccctcaagcgccagctgccagccatcttggacatcatccaagatgcggagaagaaaggagcttccctacctggagtgcgcgcttggctcgaagcactcaagaaggtggcctatgaggcgaacgatgtctttgatgagttcaagtacgaggccctccggcgtgacgccaagaagaagggacactacaagaagcttggctttgacatcgtaagcctcttccctgctcacaaccccattgtatttcgttacaggatgggcaagaagttgtgcaggattgtgcgcaaaattgagggccttgtcagagagatgaatgacttcggattcaaccaaactcagcaagcaccaccatccaagcagtggcgcaacacagattccataataattgactctgagaaggatattgtcagcaggttcagaaacgaagagaagaagaagatcgttgatatattgattgatcaagctggcgatagggacctcatcgtccttcccattgttggaatgggcgggctgggcaagaccacctttgctcagcttgtctacaatgaccctataatcaaggagcatttcaagctccagaggtggtgttgtgtgtcagatgattttgatgttgtgaagattgcaaacaacatctgtgagaccaatgagatccatcgtgaaaaggcattgcagaaccttcagaaagaagtaagtgggaagagatacctcattgtgttggatgatgtatggaatgaagatgctgataagtgggaaaaactgaaaacctgcctgaagcacggtgggaaggggagtgcaatattgacgaccactcgcaatgtgcaagtagcacgaattatgaagatgtgtattgctgatagccataatctcagaaatctagataaagtatttctgaaggaaatatttgagaatagagcattctgtttgcaaaagccaaaggctgctgagctaagcgatgtggttgataagattatggacagatgtggaggctctcctttagctgccaaagcctttgggtctatgttgagtaacaagactagcatgaaagaatggacagacatactagccagaagcaacacttgcaatgagggcacaaaaacttttcttgtactcaagctcagctatgatgacttgccatcacacttgaaacaatgctttgctttttgtgctgtatttcccaaagattatgagattggtgttgaaacattaattcagctatggatggcacatgatttcataccactgaaagaaggtgataatcttgagaaggtaggtagagaaatttttgatgagttaacttggaggtcattctttcaagatgtcaagcgaatccctcgaagagagtggtggggggagctccgtcctagaacaatatgcaagatacatgatcttatgcatgacattgccttgtctgttatgggaaaagattgtcttactatagttgataggcctaatgaaaaggagttactgtccactggtcctacacgttacttgttctcatcatatgagtatatcggaactctgttggatgattatctgaagaaacactctcccgctctccagacactgctgtatccgtatccctacaccagtgactcagcaccacacttgtcgaagtgcaattatctgcgagcactgcaactcttcagtttgagaaaacttccactctggccaaggcacttacagcacctgaggtatcttgatctctcaaataacatgttgatcgaagagcttcccaaggaaataagcatactgtataatctacagactcttaacctttgtaactgcagaaggcttgatcaacttccagaggatatgaagtatatggaaaatctccgtcacctctatacaaatggatgctcatcattgaagtgcatgcctccaggcctcgggcaactcacttctctacagactctaacatattttgtggtgagctctagtcctggttgcagtactattagagaactacaggacttgaatcttggtggtgagttagagctatctcgtcttcagtttgcaactgaagtagatgctaaagcatgcagccttggaaataaagagaaacttacacatttatctcttaaatggggtgatgacagcagtgatgaattgggccaccacaggaatgtgctcgatgctcttaaacctcatgctgtcctggagtttctaagaatacgctcctatagaggtactggcttccccgcatgggtggtaagtattaattttctgcagcatttgaccgagctccagctagatggttgtacaatgtgtgaggaatttccccaattcggtcaatttaagtcccttgaagttcttgttttgaaaaggttgaacaaacttcaaagcctatgcaatcacagttcatctgcaatatttccagcattaaaagttctcagattaaaaaaattggagatttttgagagatgggtggcaacagaaggagaagagttagcatttcctcaacttgagaatgttaaaattaaggactgcccaaagctagcaattctgcctgaagcaccaaaactcaagtttatagctctaaaagaagaaaaggcacagctatccttatcaatatttaagtccaggtatatggcttgcttgtctggggttggcctgtccgtccgtgatacagaagcagcaccaagaacagagcttgatcaggattgtgaagtatctctttcgaacctgctgttggatggttgcaactttttgttctgctcaactccattgcagccaactgttggggtctggaaatggtttggtcagcttgtgcatttggaaataaaatcttgtgatatgctcatctactggcctgaagaagagttccgttgcttggtatcattgaatagtttatccattaattcctgcagcaagctagtaggacacacccaggggaaaggatgccgtacccgtactcaagtaagggatcaactcctgccaaatcttaaaaatttaagaatacatcattgtggaagtttgacagagctttttgttctgccgccatctctcacaagtattgatatgctggattgcaatagtattgagtccatactggggcaggatgatacagagttggagagtatactacactttgatacagcatcatcatcggaacacttcaatgacctcacgtccacatgtttgctagagcagtcactttcacccagaattaatcctttgccatgtcttgattatttgcgtatagttagctgtaagaagcttcgtttcgtgccagtgcagttagatgcactccaatttttgtgtatttctgattgcaatgggctggagtcgctggattgtttgggagacctaccgtcactggaatatctataccttatgggctgcaaacatctggcatctgtaccaggaagtcttgggagttactcggcccttcagaagctccgcattgaatactgcccagctttaaatatgaagccacttcatggacatctccaacagcggcttgatagccttgaattgaaggatctatctaaggctggttcaagccatcctaatgaaggtacctttcaatttcatttaccccattttgtatctctttttccatctgtatagtttacagatgtacatattgcagcctgtagtttcaagtttatccaactccttgtattttcacatttggtatgtagtgaccgcgtacacagtttctctgatatggctattccaatatcatttatttgtataccgtaagtttgacttggattgacgtcgtcatgtgtggccgatctgtattttctatcattttggtaaaagttaatacaccatggaagtatgctctcttgtgtagtgaccgtacacagatcattcttttatgtctatcccactatcatttatttgtaaagtttgacttgctattaatgttcacagagatattctgacattgttttccatgtacagggcctaaactatgggaaccaaaatcctggaaatatatgattccttcactgcgcaagcgtgagtctgaatag

SEQ ID NO: 54 - DNA, 4088 bp, Triticum aestivum
atggcggagtttgtagtcaggccactggtatccacgttgatgaacacggcatccagctacctgctggaccagtacaaggtgatggatggcatgaaggagcagcgcgagaccctcaagcgccagctgccagccatcttggacatcatccaagatgcggagaagaaaggagcttccctacctggagtgcgcgcttggctcgaagcactcaagaaggtggcctatgaggcgaacgatgtctttgatgagttcaagtacgaggccctccggcgtgacgccaagaagaagggacactacaagaagcttggctttgacatcgtaagcctcttccctgctcacaaccccattgtatttcgttacaggatgggcaagaagttgtgcaggattgtgcgcaaaattgagggccttgtcagagagatgaatgacttcggattcaaccaaactcagcaagcaccaccatccaagcagtggcgcaacacagattccataataattgactctgagaaggatattgtcagcaggtccagaaacgaagagaagaagaagatcgttgatatattgattgatcaagctggcgatagggacctcatcgtccttcccattgttggaatgggcgggctgagcaagaccacctttgctcagcttgtctacaatgaccctataatcaaggagcatttcaagctccagaggtggtgttgtgtgtcagatgattttgatgttgtgaagattgcaaacaacatctgtgagaccaatgagatccatcgtgaaaaggcattgcagaaccttcagaaagaagtaagtgggaagagatacctcattgtgttggatgatgtatggaatgaagatgctgataagtgggaaaaactgaaaacctgcctgaagcacggtgggaaggggagtgcaatattgacgaccactcgcaatgtgcaagtagcacgaattatgaagatgtgtattgctgatagccataatctcagaaatctagataaagtatttctgaaggaaatatttgagaatagagcattctgtttgcaaaagccaaaggctgctgagctaagcgatgtggttgataagattatggacagatgtggaggctctcctttagctgccaaagcctttgggtctatgttgagtaacaagactagcatgaaagaatggacagacatactagccagaagcaacacttgcaatgagggcacaaaaacttttcttgtactcaagctcagctatgatgacttgccatcacacttgaaacaatgctttgctttttgtgctgtatttcccaaagattatgagattggtgttgaaacattaattcagctatggatggcacatgatttcataccactgaaagaaggtgataatcttgagaaggtaggtagagaaatttttgatgagttaacttggaggtcattctttcaagatgtcaagcgaatccctcgaagagagtggtggggggagctccgtcctagaacaatatgcaagatacatgatcttatgcatgacattgccttgtctgttatgggaaaagattgtcttactatagttgataggcctaatgaaaaggagttactgtccactggtcctacacgttacttgttctcatcatatgagtatatcggaactctgttggatgattatctgaagaaacactctcccgctctccagacactgctgtatccgtatccctacaccagtgactcagcaccacacttgtcgaagtgcaattatctgcgagcactgcaactcttcagtttgagaaaacttccactctggccaaggcacttacagcacctgaggtatcttgatctctcaaataacatgttgatcgaagagcttcccaaggaaataagcatactgtataatctacagactcttaacctttgtaactgcagaaggcttgatcaacttccagaggatatgaagtatatggaaaatctccgtcacctctatacaaatggatgctcatcattgaagtgcatgcctccaggcctcgggcaactcacttctctacagactctaacatattttgtggtgagctctagtcctggttgcagtactattagagaactacaggacttgaatcttggtggtgagttagagctatctcgtcttcagtttgcaactgaagtagatgctaaagcatgcagccttggaaataaagagaaacttacacatttatctcttaaatggggtgatgacagcagtgatgaattgggccaccacaggaatgtgctcgatgctcttaaacctcatgctgtcctggagtttctaagaatacgctcctatagaggtactggcttccccgcatgggtggtaagtattaattttctgcagcatttgaccgagctccagctagatggttgtacaatgtgtgaggaatttccccaattcggtcaatttaagtcccttgaagttcttgttttgaaaaggttgaacaaacttcaaagcctatgcaatcacagttcatctgcaatatttccagcattaaaagttctcagattaaaaaaattggagatttttgagagatgggtggcaacagaaggagaagagttagcatttcctcaacttgagaatgttaaaattaaggactgcccaaagctagcaattctgcctgaagcaccaaaactcaagtttatagctctaaaagaagaaaaggcacagctatccttatcaatatttaagtccaggtatatggcttgcttgtctggggttggcctgtccgtccgtgatacagaagcagcaccaagaacagagcttgatcaggattgtgaagtatctctttcgaacctgctgttggatggttgcaactttttgttctgctcaactccattgcagccaactgttggggtctggaaatggtttggtcagcttgtgcatttggaaataaaatcttgtgatatgctcatctactggcctgaagaagagttccgttgcttggtatcattgaatagtttatccattaattcctgcagcaagctagtaggacacacccaggggaaaggatgccgtacccgtactcaagtaagggatcaactcctgccaaatcttaaaaatttaagaatacatcattgtggaagtttgacagagctttttgttctgccgccatctctcacaagtattgatatgctggattgcaatagtattgagtccatactggggcaggatgatacagagttggagagtatactacactttgatacagcatcatcatcggaacacttcaatgacctcacgtccacatgtttgctagagcagtcactttcacccagaattaatcctttgccatgtcttgattatttgcgtatagttagctgtaagaagcttcgtttcgtgccagtgcagttagatgcactccaatttttgtgtatttctgattgcaatgggctggagtcgctggattgtttgggagacctaccgtcactggaatatctataccttatgggctgcaaacatctggcatctgtaccaggaagtcttgggagttactcggcccttcagaagctccgcattgaatactgcccagctttaaatatgaagccacttcatggacatctccaacagcggcttgatagccttgaattgaaggatctatctaaggctggttcaagccatcctaatgaaggtacctttcaatttcatttaccccattttgtatctctttttccatctgtatagtttacagatgtacatattgcagcctgtagtttcaagtttatccaactccttgtattttcacatttggtatgtagtgaccgcgtacacagtttctctgatatggctattccaatatcatttatttgtataccgtaagtttgacttggattgacgtcgtcatgtgtggccgatctgtattttctatcattttggtaaaagttaatacaccatggaagtatgctctcttgtgtagtgaccgtacacagatcattcttttatgtctatcccactatcatttatttgtaaagtttgacttgctattaatgttcacagagatattctgacattgttttccatgtacagggcctaaactatgggaaccaaaatcctggaaatatatgattccttcactgcgcaagcgtgagtctgaatag

SEQ ID NO: 55 - DNA, 4088 bp, Triticum aestivum
atggcggagtttgtagtcaggccactggtatccacgttgatgaacacggcatccagctacctgctggaccagtacaaggtgatggatggcatgaaggagcagcgcgagaccctcaagcgccagctgccagccatcttggacatcatccaagatgcggagaagaaaggagcttccctacctggagtgcgcgcttggctcgaagcactcaagaaggtggcctatgaggcgaacgatgtctttgatgagttcaagtacgaggccctccggcgtgacgccaagaagaagggacactacaagaagcttggctttgacatcgtaagcctcttccctgctcacaaccccattgtatttcgttacaggatgggcaagaagttgtgcaggattgtgcgcaaaattgagggccttgtcagagagatgaatgacttcggattcaaccaaactcagcaagcaccaccatccaagcagtggcgcaacacagattccataataattgactctgagaaggatattgtcagcaggtccagaaacgaagagaagaagaagatcgttgatatattgattgatcaagctggcgatagggacctcatcgtccttcccattgttggaatgggcgggctgggcaagaccacctttgctcagcttgtctacaatgaccctataatcaaggagcatttcaagctccagaggtggtgttgtgtgtcagatgattttgatgttgtgaagattgcaaacaacatctgtgagaccaatgagatccatcgtgaaaaggcattgcagaaccttcagaaagaagtaagtgggaagagatacctcattgtgttggatgatgtatggaatgaagatgctgataagtgggaaaaactgaaaacctgcctgaagcacggtgggaaggggagtgcaatattgacgaccactcgcaatgtgcaagtagcacgaattatgaagatgtgtattgctgatagccataatctcagaaatctagataaagtatttctgaaggaaatatttgagaatagagcattctgtttgcaaaagccaaaggctgctgagctaagcgatgtggttgataagattatggacagatgtggaggctctcctttagctgccaaagcctttgggtctatgttgagtaacaagactagcatgaaagaatggacagacatactagccagaagcaacacttgcaatgagggcacaaaaacttttcttgtactcaagctcagctatgatgacttgccatcacacttgaaacaatgctttgctttttgtgctgtatttcccaaagattatgagattggtgttgaaacattaattcagctatggatggcacatgatttcataccactgaaataaggtgataatcttgagaaggtaggtagagaaatttttgatgagttaacttggaggtcattctttcaagatgtcaagcgaatccctcgaagagagtggtggggggagctccgtcctagaacaatatgcaagatacatgatcttatgcatgacattgccttgtctgttatgggaaaagattgtcttactatagttgataggcctaatgaaaaggagttactgtccactggtcctacacgttacttgttctcatcatatgagtatatcggaactctgttggatgattatctgaagaaacactctcccgctctccagacactgctgtatccgtatccctacaccagtgactcagcaccacacttgtcgaagtgcaattatctgcgagcactgcaactcttcagtttgagaaaacttccactctggccaaggcacttacagcacctgaggtatcttgatctctcaaataacatgttgatcgaagagcttcccaaggaaataagcatactgtataatctacagactcttaacctttgtaactgcagaaggcttgatcaacttccagaggatatgaagtatatggaaaatctccgtcacctctatacaaatggatgctcatcattgaagtgcatgcctccaggcctcgggcaactcacttctctacagactctaacatattttgtggtgagctctagtcctggttgcagtactattagagaactacaggacttgaatcttggtggtgagttagagctatctcgtcttcagtttgcaactgaagtagatgctaaagcatgcagccttggaaataaagagaaacttacacatttatctcttaaatggggtgatgacagcagtgatgaattgggccaccacaggaatgtgctcgatgctcttaaacctcatgctgtcctggagtttctaagaatacgctcctatagaggtactggcttccccgcatgggtggtaagtattaattttctgcagcatttgaccgagctccagctagatggttgtacaatgtgtgaggaatttccccaattcggtcaatttaagtcccttgaagttcttgttttgaaaaggttgaacaaacttcaaagcctatgcaatcacagttcatctgcaatatttccagcattaaaagttctcagattaaaaaaattggagatttttgagagatgggtggcaacagaaggagaagagttagcatttcctcaacttgagaatgttaaaattaaggactgcccaaagctagcaattctgcctgaagcaccaaaactcaagtttatagctctaaaagaagaaaaggcacagctatccttatcaatatttaagtccaggtatatggcttgcttgtctggggttggcctgtccgtccgtgatacagaagcagcaccaagaacagagcttgatcaggattgtgaagtatctctttcgaacctgctgttggatggttgcaactttttgttctgctcaactccattgcagccaactgttggggtctggaaatggtttggtcagcttgtgcatttggaaataaaatcttgtgatatgctcatctactggcctgaagaagagttccgttgcttggtatcattgaatagtttatccattaattcctgcagcaagctagtaggacacacccaggggaaaggatgccgtacccgtactcaagtaagggatcaactcctgccaaatcttaaaaatttaagaatacatcattgtggaagtttgacagagctttttgttctgccgccatctctcacaagtattgatatgctggattgcaatagtattgagtccatactggggcaggatgatacagagttggagagtatactacactttgatacagcatcatcatcggaacacttcaatgacctcacgtccacatgtttgctagagcagtcactttcacccagaattaatcctttgccatgtcttgattatttgcgtatagttagctgtaagaagcttcgtttcgtgccagtgcagttagatgcactccaatttttgtgtatttctgattgcaatgggctggagtcgctggattgtttgggagacctaccgtcactggaatatctataccttatgggctgcaaacatctggcatctgtaccaggaagtcttgggagttactcggcccttcagaagctccgcattgaatactgcccagctttaaatatgaagccacttcatggacatctccaacagcggcttgatagccttgaattgaaggatctatctaaggctggttcaagccatcctaatgaaggtacctttcaatttcatttaccccattttgtatctctttttccatctgtatagtttacagatgtacatattgcagcctgtagtttcaagtttatccaactccttgtattttcacatttggtatgtagtgaccgcgtacacagtttctctgatatggctattccaatatcatttatttgtataccgtaagtttgacttggattgacgtcgtcatgtgtggccgatctgtattttctatcattttggtaaaagttaatacaccatggaagtatgctctcttgtgtagtgaccgtacacagatcattcttttatgtctatcccactatcatttatttgtaaagtttgacttgctattaatgttcacagagatattctgacattgttttccatgtacagggcctaaactatgggaaccaaaatcctggaaatatatgattccttcactgcgcaagcgtgagtctgaatag

SEQ ID NO: 56 - DNA, 4088 bp, Triticum aestivum
atggcggagtttgtagtcaggccactggtatccacgttgatgaacacggcatccagctacctgctggaccagtacaaggtgatggatggcatgaaggagcagcgcgagaccctcaagcgccagctgccagccatcttggacatcatccaagatgcggagaagaaaggagcttccctacctggagtgcgcgcttggctcgaagcactcaagaaggtggcctatgaggcgaacgatgtctttgatgagttcaagtacgaggccctccggcgtgacgccaagaagaagggacactacaagaagcttggctttgacatcgtaagcctcttccctgctcacaaccccattgtatttcgttacaggatgggcaagaagttgtgcaggattgtgcgcaaaattgagggccttgtcagagagatgaatgacttcggattcaaccaaactcagcaagcaccaccatccaagcagtggcgcaacacagattccataataattgactctgagaaggatattgtcagcaggtccagaaacgaagagaagaagaagatcgttgatatattgattgatcaagctggcgatagggacctcatcgtccttcccattgttggaatgggcgggctgggcaagaccacctttgctcagcttgtctacaatgaccctataatcaaggagcatttcaagctccagaggtggtgttgtgtgtcagatgattttgatgttgtgaagattgcaaacaacatctgtgagaccaatgagatccatcgtgaaaaggcattgcagaaccttcagaaagaagtaagtgggaagagatacctcattgtgttggatgatgtatggaatgaagatgctgataagtgggaaaaactgaaaacctgcctgaagcacggtgggaaggggagtgcaatattgacgaccactcgcaatgtgcaagtagcacgaattatgaagatgtgtattgctgatagccataatctcagaaatctagataaagtatttctgaaggaaatatttgagaatagagcattctgtttgcaaaagccaaaggctgctgagctaagcgatgtggttgataagattatggacagatgtggaggctctcctttagctgccaaagcctttgggtctatgttgagtaacaagactagcatgaaagaatggacagacatactagccagaagcaacacttgcaatgagggcacaaaaacttttcttgtactcaagctcagctatgatgacttgccatcacacttgaaacaatgctttgctttttgtgctgtatttcccaaagattatgagattggtgttgaaacattaattcagctatggatggcacatgatttcataccactgaaagaaggtgataatcttgagaaggtaggtagagaaatttttgatgagttaacttggaggtcattctttcaagatgtcaagcgaatccctcgaagagagtgatggggggagctccgtcctagaacaatatgcaagatacatgatcttatgcatgacattgccttgtctgttatgggaaaagattgtcttactatagttgataggcctaatgaaaaggagttactgtccactggtcctacacgttacttgttctcatcatatgagtatatcggaactctgttggatgattatctgaagaaacactctcccgctctccagacactgctgtatccgtatccctacaccagtgactcagcaccacacttgtcgaagtgcaattatctgcgagcactgcaactcttcagtttgagaaaacttccactctggccaaggcacttacagcacctgaggtatcttgatctctcaaataacatgttgatcgaagagcttcccaaggaaataagcatactgtataatctacagactcttaacctttgtaactgcagaaggcttgatcaacttccagaggatatgaagtatatggaaaatctccgtcacctctatacaaatggatgctcatcattgaagtgcatgcctccaggcctcgggcaactcacttctctacagactctaacatattttgtggtgagctctagtcctggttgcagtactattagagaactacaggacttgaatcttggtggtgagttagagctatctcgtcttcagtttgcaactgaagtagatgctaaagcatgcagccttggaaataaagagaaacttacacatttatctcttaaatggggtgatgacagcagtgatgaattgggccaccacaggaatgtgctcgatgctcttaaacctcatgctgtcctggagtttctaagaatacgctcctatagaggtactggcttccccgcatgggtggtaagtattaattttctgcagcatttgaccgagctccagctagatggttgtacaatgtgtgaggaatttccccaattcggtcaatttaagtcccttgaagttcttgttttgaaaaggttgaacaaacttcaaagcctatgcaatcacagttcatctgcaatatttccagcattaaaagttctcagattaaaaaaattggagatttttgagagatgggtggcaacagaaggagaagagttagcatttcctcaacttgagaatgttaaaattaaggactgcccaaagctagcaattctgcctgaagcaccaaaactcaagtttatagctctaaaagaagaaaaggcacagctatccttatcaatatttaagtccaggtatatggcttgcttgtctggggttggcctgtccgtccgtgatacagaagcagcaccaagaacagagcttgatcaggattgtgaagtatctctttcgaacctgctgttggatggttgcaactttttgttctgctcaactccattgcagccaactgttggggtctggaaatggtttggtcagcttgtgcatttggaaataaaatcttgtgatatgctcatctactggcctgaagaagagttccgttgcttggtatcattgaatagtttatccattaattcctgcagcaagctagtaggacacacccaggggaaaggatgccgtacccgtactcaagtaagggatcaactcctgccaaatcttaaaaatttaagaatacatcattgtggaagtttgacagagctttttgttctgccgccatctctcacaagtattgatatgctggattgcaatagtattgagtccatactggggcaggatgatacagagttggagagtatactacactttgatacagcatcatcatcggaacacttcaatgacctcacgtccacatgtttgctagagcagtcactttcacccagaattaatcctttgccatgtcttgattatttgcgtatagttagctgtaagaagcttcgtttcgtgccagtgcagttagatgcactccaatttttgtgtatttctgattgcaatgggctggagtcgctggattgtttgggagacctaccgtcactggaatatctataccttatgggctgcaaacatctggcatctgtaccaggaagtcttgggagttactcggcccttcagaagctccgcattgaatactgcccagctttaaatatgaagccacttcatggacatctccaacagcggcttgatagccttgaattgaaggatctatctaaggctggttcaagccatcctaatgaaggtacctttcaatttcatttaccccattttgtatctctttttccatctgtatagtttacagatgtacatattgcagcctgtagtttcaagtttatccaactccttgtattttcacatttggtatgtagtgaccgcgtacacagtttctctgatatggctattccaatatcatttatttgtataccgtaagtttgacttggattgacgtcgtcatgtgtggccgatctgtattttctatcattttggtaaaagttaatacaccatggaagtatgctctcttgtgtagtgaccgtacacagatcattcttttatgtctatcccactatcatttatttgtaaagtttgacttgctattaatgttcacagagatattctgacattgttttccatgtacagggcctaaactatgggaaccaaaatcctggaaatatatgattccttcactgcgcaagcgtgagtctgaatag

SEQ ID NO: 57 - DNA, 4088 bp, Triticum aestivum
atggcggagtttgtagtcaggccactggtatccacgttgatgaacacggcatccagctacctgctggaccagtacaaggtgatggatggcatgaaggagcagcgcgagaccctcaagcgccagctgccagccatcttggacatcatccaagatgcggagaagaaaggagcttccctacctggagtgcgcgcttggctcgaagcactcaagaaggtggcctatgaggcgaacgatgtctttgatgagttcaagtacgaggccctccggcgtgacgccaagaagaagggacactacaagaagcttggctttgacatcgtaagcctcttccctgctcacaaccccattgtatttcgttacaggatgggcaagaagttgtgcaggattgtgcgcaaaattgagggccttgtcagagagatgaatgacttcggattcaaccaaactcagcaagcaccaccatccaagcagtggcgcaacacagattccataataattgactctgagaaggatattgtcagcaggtccagaaacgaagagaagaagaagatcgttgatatattgattgatcaagctggcgatagggacctcatcgtccttcccattgttggaatgggcgggctgggcaagaccacctttgctcagcttgtctacaatgaccctataatcaaggagcatttcaagctccagaggtggtgttgtgtgtcagatgattttgatgttgtgaagattgcaaacaacatctgtgagaccaatgagatccatcgtgaaaaggcattgcagaaccttcagaaagaagtaagtgggaagagatacctcattgtgttggatgatgtatggaatgaagatgctgataagtgggaaaaactgaaaacctgcctgaagcacggtgggaaggggagtgcaatattgacgaccactcgcaatgtgcaagtagcacgaattatgaagatgtgtattgctgatagccataatctcagaaatctagataaagtatttctgaaggaaatatttgagaatagagcattctgtttgcaaaagccaaaggctgctgagctaagcgatgtggttgataagattatggacagatgtggaggctctcctttagctgccaaagcctttgggtctatgttgagtaacaagactagcatgaaagaatggacagacatactagccagaagcaacacttgcaatgagggcacaaaaacttttcttgtactcaagctcagctatgatgacttgccatcacacttgaaacaatgctttgctttttgtgctgtatttcccaaagattatgagattggtgttgaaacattaattcagctatggatggcacatgatttcataccactgaaagaaggtgataatcttgagaaggtaggtagagaaatttttgatgagttaacttggaggtcattctttcaagatgtcaagcgaatccctcgaagagagtggtggggggagctccgtcctagaacaatatgcaagatacatgatcttatgcatgacattgccttgtctgttatgggaaaagattgtcttactatagttgataggcctaatgaaaaggagttactgtccactggtcctacacgttacttgttctcatcatatgagtatatcggaactctgttggatgattatctgaagaaacactctcccgctctccagacactgctgtatccgtatccctacaccagtgactcagcaccacacttgtcgaagtgcaattatctgcgagcactgcaactcttcagtttgagaaaacttccactctggccaaggcacttacagcacctgaggtatcttgatctctcaaataacatgttgatcgaagagcttcccaaggaaataagcatactgtataatctacagactcttaacctttgtaactgcagaaggcttgatcaacttccagaggatatgaagtatatggaaaatctccgtcacctctatacaaatggatgctcatcattgaagtgcatgcctccaggcctcgggcaactcacttctctacagactctaacatattttgtggtgagctctagtcctggttgcagtactattagagaactacaggacttgaatcttggtggtgagttagagctatctcgtcttcagtttgcaactgaagtagatgctaaagcatgcagccttggaaataaagagaaacttacacatttatctcttaaatggggtgatgacagcagtgatgaattgggccaccacaggaatgtgctcgatgctcttaaacctcatgctgtcctggagtttctaagaatacgctcctatagaggtactggcttccccgcatgggtggtaagtattaattttctgcagcatttgaccgagctccagctagatggttgtacaatgtgtgaggaatttccccaattcggtcaatttaagtcccttgaagttcttgttttgaaaaggttgaacaaacttcaaagcctatgcaatcacagttcatctgcaatatttccagcattaaaagttctcagattaaaaaaattggagatttttgagagatgggtggcaacagaaggagaagagttagcatttcctcaacttgagaatgttaaaattaaggactgcccaaagctagcaattctgcctgaagcaccaaaactcaagtttatagctctaaaagaagaaaaggcacagctatccttatcaatatttaagtccaggtatatggcttgcttgtctggggttggcctgtccgtccgtgatacagaagcagcaccaagaacagagcttgatcaggattgtgaagtatctctttcgaacctgctgttggatggttgcaactttttgttctgctcaactccattgcagccaactgttggggtctggaaatggtttggtcagcttgtgcatttggaaataaaatcttgtgatatgctcatctactggcctgaagaagagttccgttgcttggtatcattgaatagtttatccattaattcctgcagcaagctagtaggacacacccaggggaaaggatgccgtacccgtactcaagtaagggattaactcctgccaaatcttaaaaatttaagaatacatcattgtggaagtttgacagagctttttgttctgccgccatctctcacaagtattgatatgctggattgcaatagtattgagtccatactggggcaggatgatacagagttggagagtatactacactttgatacagcatcatcatcggaacacttcaatgacctcacgtccacatgtttgctagagcagtcactttcacccagaattaatcctttgccatgtcttgattatttgcgtatagttagctgtaagaagcttcgtttcgtgccagtgcagttagatgcactccaatttttgtgtatttctgattgcaatgggctggagtcgctggattgtttgggagacctaccgtcactggaatatctataccttatgggctgcaaacatctggcatctgtaccaggaagtcttgggagttactcggcccttcagaagctccgcattgaatactgcccagctttaaatatgaagccacttcatggacatctccaacagcggcttgatagccttgaattgaaggatctatctaaggctggttcaagccatcctaatgaaggtacctttcaatttcatttaccccattttgtatctctttttccatctgtatagtttacagatgtacatattgcagcctgtagtttcaagtttatccaactccttgtattttcacatttggtatgtagtgaccgcgtacacagtttctctgatatggctattccaatatcatttatttgtataccgtaagtttgacttggattgacgtcgtcatgtgtggccgatctgtattttctatcattttggtaaaagttaatacaccatggaagtatgctctcttgtgtagtgaccgtacacagatcattcttttatgtctatcccactatcatttatttgtaaagtttgacttgctattaatgttcacagagatattctgacattgttttccatgtacagggcctaaactatgggaaccaaaatcctggaaatatatgattccttcactgcgcaagcgtgagtctgaatag

SEQ ID NO: 58 - DNA, 20 bp, Artificial Sequence
  primer
aatgatacggcgaccaccga

SEQ ID NO: 59 - DNA, 21 bp, Artificial Sequence
  primer
caagcagaagacggcatacga

SEQ ID NO: 60 - DNA, 20 bp, Artificial Sequence
  primer
cccaaatcaacacacaccag

SEQ ID NO: 61 - DNA, 20 bp, Artificial Sequence
  primer
tcgcgacgaatcgtatatgt

SEQ ID NO: 62 - DNA, 30 bp, Artificial Sequence
  primer
caaggctgctattgctgtgtttggccctga

SEQ ID NO: 63 - DNA, 28 bp, Artificial Sequence
  primer
gagcgtggtcttgcccaaccctccatat

SEQ ID NO: 64 - DNA, 26 bp, Artificial Sequence
  primer
gttcttgagcagcttgtattcatccg

SEQ ID NO: 65 - DNA, 21 bp, Artificial Sequence
  primer
caacatagctcccaacttccg

SEQ ID NO: 66 - DNA, 21 bp, Artificial Sequence
  primer
acttccgccattgttgctctc

SEQ ID NO: 67 - DNA, 30 bp, Artificial Sequence
  primer
ctccttctaattagatgcatacattagagg

SEQ ID NO: 68 - DNA, 20 bp, Artificial Sequence
  primer
gtagctcaaaccgtcggtcc

SEQ ID NO: 69 - DNA, 19 bp, Artificial Sequence
  primer
gattcgtcgcgatgagatc

SEQ ID NO: 70 - DNA, 26 bp, Artificial Sequence
  primer
ggcctaaactatgggaaccaaaatcc

SEQ ID NO: 71 - DNA, 25 bp, Artificial Sequence
  primer
ggaaatatatggttccttcactgcg

SEQ ID NO: 72 - DNA, 23 bp, Artificial Sequence
  primer
gcaagcgtgagtctgaatagagg

SEQ ID NO: 73 - DNA, 22 bp, Artificial Sequence
  primer
cagtggcctgactacaaactcc

SEQ ID NO: 74 - DNA, 19 bp, Artificial Sequence
  primer
cctgctttgggttgtatcc

SEQ ID NO: 75 - DNA, 25 bp, Artificial Sequence
  primer
gctggattgcaatagtattgagtcc

SEQ ID NO: 76 - DNA, 22 bp, Artificial Sequence
  primer
gagagagagagagcaacaatgg

SEQ ID NO: 77 - DNA, 28 bp, Artificial Sequence
  primer
atagaatatagatgcacgctagatcttt

SEQ ID NO: 78 - DNA, 28 bp, Artificial Sequence
  primer
ctgaattcgtgatacttgtcttacttat

SEQ ID NO: 79 - DNA, 20 bp, Artificial Sequence
  primer
gcctaactccagaccatttc

SEQ ID NO: 80 - DNA, 21 bp, Artificial Sequence
  primer
aacttgactcccttgaagagg

SEQ ID NO: 81 - DNA, 21 bp, Artificial Sequence
  primer
cgcagatggatttctgaaggc

SEQ ID NO: 82 - DNA, 22 bp, Artificial Sequence
  primer
atgtgccaaatatcatagtccg

SEQ ID NO: 83 - DNA, 18 bp, Artificial Sequence
  primer
caaataacggcttctggg

SEQ ID NO: 84 - DNA, 19 bp, Artificial Sequence
  primer
atggactcggcaatactcc

SEQ ID NO: 85 - DNA, 21 bp, Artificial Sequence
  primer
aagctccgtgattcctgtaag

SEQ ID NO: 86 - DNA, 25 bp, Artificial Sequence
  primer
agtactgtaataattgattccgtcg

SEQ ID NO: 87 - DNA, 19 bp, Artificial Sequence
  primer
aacaatggcggaagttctg

SEQ ID NO: 88 - DNA, 24 bp, Artificial Sequence
  primer
atgttctcttcagaggatttgtca

SEQ ID NO: 89 - DNA, 29 bp, Artificial Sequence
  primer
cgtgatacttgtcttacttattcctagtc

SEQ ID NO: 90 - DNA, 20 bp, Artificial Sequence
  primer
ccgtgctgtataccatgtga

SEQ ID NO: 91 - DNA, 20 bp, Artificial Sequence
  primer
gcgaactttactgtcaacgg

SEQ ID NO: 92 - DNA, 19 bp, Artificial Sequence
  primer
caaagatctcatcgcgacg

SEQ ID NO: 93 - DNA, 20 bp, Artificial Sequence
  primer
caatttcatcaagacatgcg

SEQ ID NO: 94 - DNA, 25 bp, Artificial Sequence
  primer
gatgttatttaattatggtttggcc

SEQ ID NO: 95 - DNA, 20 bp, Artificial Sequence
  primer
aatgccagcctgttaaacgc

SEQ ID NO: 96 - DNA, 20 bp, Artificial Sequence
  primer
tgtgttagatccgtgctgct

SEQ ID NO: 97 - DNA, 20 bp, Artificial Sequence
  primer
atgatgtggtgtggttgggc

SEQ ID NO: 98 - DNA, 21 bp, Artificial Sequence
  primer
cttgagtgctgttggtcttcc

SEQ ID NO: 99 - DNA, 23 bp, Artificial Sequence
  primer
ggcaactctgttctatagctcgt

SEQ ID NO: 100 - DNA, 20 bp, Artificial Sequence
  primer
cttccacatccccaccttcc

SEQ ID NO: 101 - DNA, 21 bp, Artificial Sequence
  primer
tgccttgaacagatccatcca

SEQ ID NO: 102 - DNA, 20 bp, Artificial Sequence
  primer
ctgagcatggagtagcagca

SEQ ID NO: 103 - DNA, 20 bp, Artificial Sequence
  primer
gaatgggtcgttacgttgcg

SEQ ID NO: 104 - DNA, 20 bp, Artificial Sequence
  primer
atggcggaagttctggtgag

SEQ ID NO: 105 - DNA, 20 bp, Artificial Sequence
  primer
ttgacgactcctcctcctct

SEQ ID NO: 106 - DNA, 20 bp, Artificial Sequence
  primer
ttgacgagtcctcctcctct

SEQ ID NO: 107 - DNA, 21 bp, Artificial Sequence
  primer
ctcatgcataatcggttgcct

SEQ ID NO: 108 - DNA, 21 bp, Artificial Sequence
  primer
ctcatgcataatccgttgcct

SEQ ID NO: 109 - DNA, 20 bp, Artificial Sequence
  primer
agatcggaccagcctgacta

SEQ ID NO: 110 - DNA, 20 bp, Artificial Sequence
  primer
aagcccgtcaaagtccacat

SEQ ID NO: 111 - DNA, 20 bp, Artificial Sequence
  primer
tccatcacgcacagccaaat

SEQ ID NO: 112 - DNA, 19 bp, Artificial Sequence
  primer
cgggatgtactggtggtcc

SEQ ID NO: 113 - DNA, 20 bp, Artificial Sequence
  primer
cgttggcgtgttagagttgc

SEQ ID NO: 114 - DNA, 20 bp, Artificial Sequence
  primer
ggctgtgaagaaagctgtcc

SEQ ID NO: 115 - DNA, 20 bp, Artificial Sequence
  primer
atagggtatgacggcaaggc

SEQ ID NO: 116 - DNA, 20 bp, Artificial Sequence
  primer
aggtgggttgggaaacttga

SEQ ID NO: 117 - DNA, 20 bp, Artificial Sequence
  primer
agatgggttgggaaacttga

SEQ ID NO: 118 - DNA, 21 bp, Artificial Sequence
  primer
acagttgcagaagtttgaggc

SEQ ID NO: 119 - DNA, 21 bp, Artificial Sequence
  primer
acagttgcagaggtttgagct

SEQ ID NO: 120 - DNA, 20 bp, Artificial Sequence
  primer
tgcttcaggtgtgctctcaa

SEQ ID NO: 121 - DNA, 20 bp, Artificial Sequence
  primer
gctagtggcgtctgagatgt

SEQ ID NO: 122 - DNA, 23 bp, Artificial Sequence
  primer
agtttggtgtcattgggttttcg

SEQ ID NO: 123 - DNA, 21 bp, Artificial Sequence
  primer
cgagatgcgcctttggttatg

SEQ ID NO: 124 - DNA, 20 bp, Artificial Sequence
  primer
cgtcgcgatgagatctttga

SEQ ID NO: 125 - DNA, 22 bp, Artificial Sequence
  primer
acaacttcatccacccgaatca

SEQ ID NO: 126 - DNA, 21 bp, Artificial Sequence
  primer
cgagatgcgcctttggttatg

SEQ ID NO: 127 - DNA, 20 bp, Artificial Sequence
  primer
tggcggtcaaagatgcgtat

SEQ ID NO: 128 - DNA, 20 bp, Artificial Sequence
  primer
tggatggcatgaaggagcag

SEQ ID NO: 129 - DNA, 20 bp, Artificial Sequence
  primer
tgatcaagctggcgataggg

SEQ ID NO: 130 - DNA, 20 bp, Artificial Sequence
  primer
atggacagatgtggaggctc

SEQ ID NO: 131 - DNA, 20 bp, Artificial Sequence
  primer
ctgtccactggtcctacacg

SEQ ID NO: 132 - DNA, 20 bp, Artificial Sequence
  primer
gctctagtcctggttgcagt

SEQ ID NO: 133 - DNA, 20 bp, Artificial Sequence
  primer
tttgagagatgggtggcaac

SEQ ID NO: 134 - DNA, 20 bp, Artificial Sequence
  primer
aaaggatgccgtacccgtac

SEQ ID NO: 135 - DNA, 20 bp, Artificial Sequence
  primer
gacatctccaacagcggctt

SEQ ID NO: 136 - DNA, 30 bp, Artificial sequence
  primer
tgcgctcaccagaacttccgccattgttgc

SEQ ID NO: 137 - DNA, 19 bp, Artificial Sequence
  primer
gaaattcctgctgcattgc

SEQ ID NO: 138 - DNA, 2026 bp, Artificial Sequence
  promoter construct derived from the Zea mays ubiquitin prromoter
atgaggtctcaggaggcggccgcgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggaatgagagaccatga

SEQ ID NO: 139 - DNA, 2419 bp, Artificial Sequence
  promotor construct dervied from the Aegilops tauschii Sr33 promoter
atgaggtctcaggaggcggccgctttaagagtgttgaggatgtgcttacttaaatttcaaaagggctatttagggataatatttggtgaagcatggctggtggactgaccataggtacccactgaataaacatatcagcccaaaggcagagggtatccctccctgtaatacgtactagtattcgaggagcgtgctaaagtagtatcctctcttgatgctcctcgtctccctccactgagtactcccttcctctcctcattctcatctcagtcctctcctcctccctcgaataagatagatccgcccttgttgctgatctcatctcgcctcctattggcctcgcccctgccaactgactgctctattggtgaccgtggactttttgggtatatatatttcctgtcgatttgtttccacttaaagtagcaatgcttggatctaaaacttattacttctcctgcttcagattctgatccatttgtgttgattgaactcagggtgggatcgtggggctctgtatctatctaggatggatattccaagcaatttactctcttgagtgctgttggtcttcctctgctcctcgtctccgcttcctctcagtctcctccattgcgctgcctggaacagatcgatccgccttgttgctgatctcatccatcctccgtggagatttcgggtggcagtttccagtgactattcagagcaccatactagtggcctggtaaaaatttccctcccatctttcttgctattctcttcttattaatctgctgatttgcttgatggtaagttcttacttattcttccagatcgagtgaagcgacatccgccgccgtcttgtcccctacgacgccgctgtgttctgctctgtcctcctctgccggtgaagcatcaacggtgacggccatccggtgttgacgccgcggctgtgttctcctctgccgtgaagtatcaaaggtgggtttggatggatatcacagtttggattggcaactctgttctatagctcgttgaaattaaagcttcacacagttttgattggattacagctccccatattcatctattttgcaccatgcatcgaatccactgacctccacacgctcacggatctggcctctggtgcccacacgctcacggatccgacagagtgctcccttcctatcatctcagtcctcatctcctggtcgatccggcttcttgtttggtgagctcgtccaacctccgagctcgcccctgacacctgtggagtggaggtatatttctttccagctgaagtacgcttggatctaaaaacttacgtctcctgcttcactgcttgcttgggagtctgatcgatttgtgttggttgaatcatttggggtggcagtggagcagctagcaagaatcatggagtttccaatcattattcagagcaccacgcatggaatccactgacctggtaactttgtctcatctttcttgctactgaaatcttccacatccccaccttccttgttcatctgctgatttcccagattatacttccagattgagtgaagcgccgtcttgtcccctcacggatctggcctctggtgcccagccgccgctttcgcttcgttgtccgacgaggccaccgccgctgtgttctgctctgccgtgaagcacaaaaaggtggggtcttcctctgctctttctccactgacggcgatccgaccttgacacccgtggccgtggcagtggggtcttcctctgctctgtttttttaccagttattggatctaaaaagggatctaaaagttattacttctcctgcttgagattctgaccgatttgtgttgattgaatccagggtggggtcgtggggctctgtatctatctagtacggagtaccactgtattccaagcaatttactctcttgactgctgttggacttcctctgtccccgcttccattgtgctgccttgaacagatccatccaccttgttgctaatctcatccaacctccgggtatgtttcttgtcgatttgtttccagtaaagtagcaatgcttgggtctaaaaagtcattgcttctcctgcttgacgagtctcattgatttgcccagtcattattcagagcaccatgcatccaaggcgctgacccggctataagtttttattacagggccgccgtgttgtccccatcgagcaaagcgtttaatccactgacccgcttcgttgtccgcacagcgtgaccatccgacgaagacgccgccgttgtgttctgctctcctctgaagcatcaaaaggtgggcttggtccagatccccacattcatcgatttggcttgccaactcagttccaccagagcttggattgtgttacagatccctaaattcatcgatttgcaggtttcagctgattgatcaagagagctctcaatgagagaccatga

SEQ ID NO: 140 - DNA, 1277 bp, Artificial Sequence
  promoter construct derived from the promoter of the Sr22 gene of T. monococcum accession PI190945
atgaggtctcaggaggcggccgcaactacctgggtgactgtatttatcctcagtggaccactattgtcaagacagtacccaaccatgtcggagagaagaggaaaagatttgcccaaaagcaagagagtgctaggaaggatgtcgagcgtgcctttggtgttttgcaatctcgatggggcatcgttcggtatcctgctaatacctggagcacgcagaaactgtgggaggtgatgactgcttgtgtgatcatgcacaatatgatcgtagaagacaagcgcccggaacgtctgtacgatcaagggtttcagtttcaggatgagaatgttgtgcctgagcatggagtagcagcaacgtttgaatagttcacccaatttcatcaagacatgcgtgattgggaaactcacgtgcagctgcaaaataatttgattgagtatatgtgggtcatgttggcaaccaataaatgtatcttcttttattcgtttgcaaaactatgaaacatttatttttatttgtatccggtttgtaaaactatactattttattctgtaaactatgttatctgacaatatgtttgaatgcaaactaatataatattgggcggccaaccggccgcgttggcacgttgggtgcgctgccgactcaaatctaaaaaaagacggacgccgggcgggcggccgacccaaacgaacaaaaagcggacgaaatcgccgtccatttgggtcgctccatcggagttgctctgtctggccgccaaatggggacgtgacggacaccgagtgaactcgtgcggtgtgtccgcttcacatctaaatttaggtaaaaaaatgaatccgtatggacatgttttgagaatgggtcgttacgttgcgacaatatttttatccacaacgacctaaacaaatgcgggcagatgaaatgtatggctgcgttggagatgctgttaacggagcaaagtcgttggtagtcggaccgagcaaagtaattgctgaggcaggtagtggacgagactgtagaaaggttccacgcttaatatcttgagcagtacttgtagcacatgtgtccctgcaaagctgtctccgtgctgtataccatgtgaattgcttttctcaaaagtagtggagtaccctaccgtgtttcattagtcttgccggcttcatagacaaaggattcttttttcccgtgccatcgccatctgcaagcccaaatcaacacacaccagagagagagagagagagagagagagagagagagagagagcaacaaatgagagaccatga

SEQ ID NO: 141 - DNA, 2981 bp, Artificial Sequence
  Coding_region-1_Sr22_locus_construct
atgaggtctcaaatgatggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtagagaccatga

SEQ ID NO: 142 - DNA, 2997 bp, Artificial Sequence
  Coding_region-2_Sr22_locus_ Domesticated_BsaI_construct
atgaggtctcaacgtccggccacggcagtgagacgcggtactcccggtggtactaactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagaaaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctaggcttagagaccatga

SEQ ID NO: 143 - DNA, 2974 bp, Artificial Sequence
  Coding_region-1_ PI190945_construct
atgaggtctcaaatgatggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtaccagatcttgttctctttacagtactattagtacctaccatcagatttgtgaccgatttgttgccactcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcgcaaatcaccaagaaagacgaggcttgctctagattagatgatatacaactcatcatcgacaagattcgagaattcctccaagacacaaggtatgtatgtgagatctactacgaagtaacattgcttaattagctcatgcataatccgttgcctagaattttgctaatgagattgctttgtgtgatttactttcgtcctcaacttgtatgactgcgcttaaactttcaagtcattgtttcttgcaacttatgtcgatctgttcactaattaagatatagctaaaatgtgtttgccaatttctgtcgccacacattttctaatttgattgccacaggtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtagagaccatga

SEQ ID NO: 144 - DNA, 2994 bp, Artificial Sequence
  Coding_region-2_PI190945_Domesticated_BsaI_construct
atgaggtctcaacgtccggccacggcagtgagacgcggtactcccggtggtactaactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagaaaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacgggttgcttttggacaatccgaagatagagcagcaggatattgagatgattggattgatacccaatctgatcgatttgacactgtatttacgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctaccacttcatcgaaaagcccaaatctggtgcggtcgatttcgactttggcatccaacacctctccagccttgctcgcctcactgtcggcttattatgcgttggctcgacggcggcggaagtagaggctgcggaggatgctttcaagagcatggccgaggcgaaccccaaccgtccaatactggagatgacaagactttatccgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctaggcttagagaccatga

SEQ ID NO: 145 - DNA, 2975 bp, Artificial Sequence
  Coding_region-1_PI573523_construct
atgaggtctcaaatgatggcggaagttctggtgagcgcatccacaggcgcaatgggttccctcctccggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtaccagatcttgttctctttacagtactattagtacctaccatcagatttgtgaccgatttgttgccactcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccatcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagttggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtagagaccatga

SEQ ID NO: 146 - DNA, 2998 bp, Artificial Sequence
  Coding_region-2_PI573523_Domesticated_BsaI_construct
tgaggtctcaacgtccggccatggcagtgagacgcggtactcccggtggtactaactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcggcattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcttgttggtcacaacaagggaaacaaaagaagagtgggatcgggtgcgacattcaatacgctcttcaaaggtcaaaagtgatataatagaaaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcggagtattgccgagtccatgacaccatccttgatttcctaattgacaaatcctctgaagagaacatgtgtactgtcctgaagaaacaatgcaagcctaatggcatagttcgtcggctctctctaatggggaatgaggatgaagaaatcatggagcaattggatctgtcacacgctcggtcaatcagtgcttttggggatatcaagctattgccttcgcttgggaggtcaaaatgcttgcgcgtgctagacttgcaaggctgctatcagttgaaaaatcatcatatcaaggatattgaaagactctatcagctgagatacttggatatctcttttacaggaatcacggagcttcccaggcaaattggggagttgctgtatctagagacgctagttagtacatcctatggattacgtgagcttcctgaaagcacaagtcggctacaacgactggcacgtttgtttgttgacagcggttgtaagcttccagatgggttgggaaacttgataaacttgcaagagcttgactgcgttgatgccttgcagttgaagcatgtggaagagctcggcaaactaacaaatctgagaaagctgaggattaaattggacactgatgggattgaaggcaacaaattagaacagtccaaggaaaagctggtgtcctctctctgtaaactggacgaatgcggcctcctttccctgagtatttattattatctgagagaaaaggatggagaagagccgttcctccctgctttgggttgtatccaggaggtttttgtacatggacaagatatcagccggattagcagatggctcgcgtcacttcccaacctacacaggttgtttttgaaccaaccgaagatagagcagcaggatattgagatgattggattgatacccaatctgatggatttgacactgtatttatgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctacgacttcatcggaaagcccaaatctggtgcggtcgatttcgactttggcatccaacacctctccagccttgctcgcctcactgtcggcttatcctgcgttggctcgacggtggcggaagtagaggccgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcggtagatcaaaagatgtgcatatgcttcaatcttttttccggtaatctatttcagctacaacgccggccgtcaagtcctaggcttagagacctga

SEQ ID NO: 147 - DNA, 1459 bp, Artificial Sequence
  Terminator_Sr33_native_construct
atgaggtctcagcttctgacgttgcttcaggtgtgctctcaatctatacatatttactcatcatattattctccacctttttttccatctctagagctcagcttgtcattgcattgttcaattgtgcttctctagcagctacggaaattctgaacaggcaaaggtaattttacagaagtttctttggcataagtatctgagaaaaatgcacttggcacaatttaccttttcgcagtagaaaagagtcagtggatcataccttcttaattgttcgattgctcgtaatacttgggggcactctatgattgctgtgtgcttttagttttgatatagttcctgttagcatggacagactgtgtgattggttcatgaatttcagggtggttctaatgaggaaatgatgcttgcttcagaaatagtttccatttgtacctaagctgtgtagttggtaaagttgcattttggatgttctgttggtatagcttacagaagaaagacttgcgttgtgcaggtaccaggggcgcaggttactgctagtggcgtctgagatgtttcataaacgttgggtgggcaccggtcatgcaaaaaattgaaggataaaaaggttccgagaggttgtgtgatgtgctccttttaaatggcagtcgcttgcataaagagatgttgcttggttttttagtaaagcgttgtagtaagttgctctgtttcggctgagagccatcgttgttgctgtctgttacatcgaatggctggctcatgtcatgttgatgttttttttatctgaaccggacaaacctgagggtgtagtatcatgtttgtaatgactgaaattctgggctcacccgagctccttaattcgtaaacaactgcgactcattgttggattccttacttcagaaaatatttacttgctctggctcatacagctctgcatgttttgtagtggtttgtcgctgtttaggtgctgcttcagactcctggtacctttggccgctgctgctactgcatgagctttgtatggcattgttagtatagtttggtgtcattgggttttcgccccatggtgagtgtccattgcgcgcactcgcagcggtttcctggcgataagttgaacttgatctttctctttcccacctcctaaacgtctattcagacttgtgtatatttgcattacggggattacccgagttcaaaaataaatattatttactagttctgccaatgtgtttccgttacatacaaataaaagggtgcttccagctacaagtatatttttgagaagggccattgcaaaacgaaatgaagcccaaattctaccaacatgtttctgtcacatatacattaaaaaaacggtgtaaatgtcccgtcaaaaaagggtgtatgtaggaaaaggagttcgacgccgccagctccctcctaacgctcagattgtcttcgcggccgccgctagagaccatga

SEQ ID NO: 148 - DNA, 1598 bp, Artificial Sequence
  Terminator_Schomburgk_Domesticated_BsaI_construct
atgaggtctcagctttgcctaaaccgagatgcgcctttggttatggagcccaagtcacgtactcggattggatgctgcagcaaatgatacttctgtacatgtctgcaagtatcacgaattagtggaatgactaggaataagtaagacaagtatcacgaattcagagtcggatgcaatttttttcttttcttttgggcataagtagattgtcatttgagtatttttttccattaatatttgtgtattcttagattgagactttgatatgtaacccagatttctgttgttaggaaacacataccgtgtagcttatcagaagaaaaagatctagcgtgcatctatattctatcggactatgatatttggcacatgtgtgccatataaacaaaactgtcacacctctatttccttcactctaaatagatgtatacattagtttgattctttcttctttcacgtgcatttctccttctaattagatgcatacattagaggacaaaaaagacgatgtcattctagattttctttattaaaatatttaaaatgttttgtagctcaaaccgtcggtccgatgtaaaaaccgtttttacatatacgattcgtcgcgatgagatctttgaaactagatcctatgttgacatgtttcgatgactttttttaaccaaaatttaccatgccttttatatgcaagttaccgtgctatttccacataagtcatcggaggcataaaaatggttcaccgacactacagttcatatattaccatgatgtttacatataagttaccgggagggggggggggggtgtctgttttcaataatttccccaccgagtcaaatattaccatagtatatgtacgtaagttatcaggtatccgatgggtatattaccatggctatcttttaaaaaaatctctaatttaccgcggtgtttgtatctaaattatcaagtttgtggtgcctaatttactatgctatttacatacaaaagttaccagtgtattttttgacaattttttactattcttccccaaatcaagactattaccgtgctgtttacacacaagttaccgggtatattttcaacaacttcatccacccgaatcaaacttatcatgatgtttgtgagtaacttatcatgtctgcaatgcgtatattaccattctatttaaacaaaatttaccaacgatatgcttcaaacaattttttacgtgggtcaaagctagcatactgtttttgcgtaagttattgtatctgcaataaatatattaccgtgctatttacctagaagttattgggggtaatgttcttcaacgaaaaaaaattcagggtcaaaaaattattgtggtgtttgaacgagagttattagctctccgatgggtaaattatcatgttatttgcacataaattaccgagggtatgcttttcaacaacttcctccatccaggtcaaagttatcatggtgtttttgctcaagttttcaagtttgtggtgcgtatattaccacgatgttgactgtttacaaggtttttgagtcgccgactaatcgccgactaatcgtcgagtcgtcgcggcggcggccgccgctagagaccatga

SEQ ID NO: 149 - DNA, 958 bp, Artificial Sequence
  Terminator_PI190945_domesticated_BsaI_construct
atgaggtctcagctttgcctaaaccgagatgcgcctttggttatggagcccaagtcacgtactctgattggatgctgcagcaaatgaagctacacatttctattcgggctacctctttttttttgaaactctattcgggctacctctttgtctcaaagctggtgtactcttgtgatttgtgttgcgcaactgatacttctgtgtatgtctgcaagtatcacgaattagtgggaatgactaggaataagtaagacaagtatcacgaattcagagtcacatgcaatttttttcttttcttttgggcataagtagattgccatttgagtattttttccattaatatttgcgtattcttagattgggacttagatatgtaacccagatttctgttgttaggaaacacataccgtgtagcttatcaaaagaaaaagatctttagagaaaataacatcattagattgttcaacttggatgaaaaatgtgaaaatggccaaaccataattaaataacatcattagattgttccctgcaaaaaatacatcattagattgttaaatataattgaaccttttgttgtcttttttctaacatgcacgtggcggtcaaagatgcgtattaaaagactatgtcagcatgtttattgtgagtcttggtatgaatattgctctctcctgattcatccattatgcctggcaacattttctatacaaaaatgtaaattgaattaacatgcagacgactgtcaaagatatactactgtacatcaaagaccacgtcaatgcgtagacagatttgtgtttacaaactaggcgggtagtgggaaaggatcccatatgtgttgaattgttgattatccacttttgctaggaacggatctacatagtaaaagccgaccccccaagttcgccccagaagccgttatttgaaattaaaatgcggccgccgctagagaccatga

SEQ ID NO: 150 - DNA, 4118 bp, Artificial Sequence
  Coding_region_Sr45_locus_ domesticated_BsaI construct
atgaggtctcaaatgatggcggagtttgtagtcaggccactggtatccacgttgatgaacacggcatccagctacctgctggaccagtacaaggtgatggatggcatgaaggagcagcgcgaaaccctcaagcgccagctgccagccatcttggacatcatccaagatgcggagaagaaaggagcttccctacctggagtgcgcgcttggctcgaagcactcaagaaggtggcctatgaggcgaacgatgtctttgatgagttcaagtacgaggccctccggcgtgacgccaagaagaagggacactacaagaagcttggctttgacatcgtaagcctcttccctgctcacaaccccattgtatttcgttacaggatgggcaagaagttgtgcaggattgtgcgcaaaattgagggccttgtcagagagatgaatgacttcggattcaaccaaactcagcaagcaccaccatccaagcagtggcgcaacacagattccataataattgactctgagaaggatattgtcagcaggtccagaaacgaagagaagaagaagatcgttgatatattgattgatcaagctggcgatagggacctcatcgtccttcccattgttggaatgggcgggctgggcaagaccacctttgctcagcttgtctacaatgaccctataatcaaggagcatttcaagctccagaggtggtgttgtgtgtcagatgattttgatgttgtgaagattgcaaacaacatctgtgagactaatgagatccatcgtgaaaaggcattgcagaaccttcagaaagaagtaagtgggaagagatacctcattgtgttggatgatgtatggaatgaagatgctgataagtgggaaaaactgaaaacctgcctgaagcacggtgggaaggggagtgcaatattgacgaccactcgcaatgtgcaagtagcacgaattatgaagatgtgtattgctgatagccataatctcagaaatctagataaagtatttctgaaggaaatatttgagaatagagcattctgtttgcaaaagccaaaggctgctgagctaagcgatgtggttgataagattatggacagatgtggaggctctcctttagctgccaaagcctttgggtctatgttgagtaacaagactagcatgaaagaatggacagacatactagccagaagcaacacttgcaatgagggcacaaaaacttttcttgtactcaagctcagctatgatgacttgccatcacacttgaaacaatgctttgctttttgtgctgtatttcccaaagattatgagattggtgttgaaacattaattcagctatggatggcacatgatttcataccactgaaagaaggtgataatcttgagaaggtaggtagagaaatttttgatgagttaacttggaggtcattctttcaagatgtcaagcgaatccctcgaagagagtggtggggggagctccgtcctagaacaatatgcaagatacatgatcttatgcatgacattgccttgtctgttatgggaaaagattgtcttactatagttgataggcctaatgaaaaggagttactgtccactggtcctacacgttacttgttctcatcatatgagtatatcggaactctgttggatgattatctgaagaaacactctcccgctctccagacactgctgtatccgtatccctacaccagtgactcagcaccacacttgtcgaagtgcaattatctgcgagcactgcaactcttcagtttgagaaaacttccactctggccaaggcacttacagcacctgaggtatcttgatctctcaaataacatgttgatcgaagagcttcccaaggaaataagcatactgtataatctacagactcttaacctttgtaactgcagaaggcttgatcaacttccagaggatatgaagtatatggaaaatctccgtcacctctatacaaatggatgctcatcattgaagtgcatgcctccaggcctcgggcaactcacttctctacagactctaacatattttgtggtgagctctagtcctggttgcagtactattagagaactacaggacttgaatcttggtggtgagttagagctatctcgtctgcagtttgcaactgaagtagatgctaaagcatgcagccttggaaataaagagaaacttacacatttatctcttaaatggggtgatgacagcagtgatgaattgggccaccacaggaatgtgctcgatgctcttaaacctcatgctgtcctggagtttctaagaatacgctcctatagaggtactggcttccccgcatgggtggtaagtattaattttctgcagcatttgaccgagctccagctagatggttgtacaatgtgtgaggaatttccccaattcggtcaatttaagtcccttgaagttcttgttttgaaaaggttgaacaaacttcaaagcctatgcaatcacagttcatctgcaatatttccagcattaaaagttctcagattaaaaaaattggagatttttgagagatgggtggcaacagaaggagaagagttagcatttcctcaacttgagaatgttaaaattaaggactgcccaaagctagcaattctgcctgaagcaccaaaactcaagtttatagctctaaaagaagaaaaggcacagctatccttatcaatatttaagtccaggtatatggcttgcttgtctggggttggcctgtccgtccgtgatacagaagcagcaccaagaacagagcttgatcaggattgtgaagtatctctttcgaacctgctgttggatggttgcaactttttgttctgctcaactccattgcagccaactgttggggtctggaaatggtttggtcagcttgtgcatttggaaataaaatcttgtgatatgctcatctactggcctgaagaagagttccgttgcttggtatcattgaatagtttatccattaattcctgcagcaagctagtaggacacacccaggggaaaggatgccgtacccgtactcaagtaagggatcaactcctgccaaatcttaaaaatttaagaatacatcattgtggaagtttgacagagctttttgttctgccgccatctctcacaagtattgatatgctggattgcaatagtattgagtccatactggggcaggatgatacagagttggagagtatactacactttgatacagcatcatcatcggaacacttcaatgacctcacgtccacatgtttgctagagcagtcactttcacccagaattaatcctttgccatgtcttgattatttgcgtatagttagctgtaagaagcttcgtttcgtgccagtgcagttagatgcactccaatttttgtgtatttctgattgcaatgggctggagtcgctggattgtttgggagatctaccgtcactggaatatctataccttatgggctgcaaacatctggcatctgtaccaggaagtcttgggagttactcggcccttcagaagctccgcattgaatactgcccagctttaaatatgaagccacttcatggacatctccaacagcggcttgatagccttgaattgaaggatctatctaaggctggttcaagccatcctaatgaaggtacctttcaatttcatttaccccattttgtatctctttttccatctgtatagtttacagatgtacatattgcagcctgtagtttcaagtttatccaactccttgtattttcacatttggtatgtagtgaccgcgtacacagtttctctgatatggctattccaatatcatttatttgtataccgtaagtttgacttggattgacgtcgtcatgtgtggccgatctgtattttctatcattttggtaaaagttaatacaccatggaagtatgctctcttgtgtagtgaccgtacacagatcattcttttatgtctatcccactatcatttatttgtaaagtttgacttgctattaatgttcacagagatattctgacattgttttccatgtacagggcctaaactatgggaaccaaaatcctggaaatatatgattccttcactgcgcaagcgtgagtctgaataggcttagagaccatga

SEQ ID NO: 151 - DNA, 9744 bp, Artificial Sequence
  Whole_gene_Sr33-P_Sr22-CR_Sr33-T_native_construct
atgagcggccgctttaagagtgttgaggatgtgcttacttaaatttcaaaagggctatttagggataatatttggtgaagcatggctggtggactgaccataggtacccactgaataaacatatcagcccaaaggcagagggtatccctccctgtaatacgtactagtattcgaggagcgtgctaaagtagtatcctctcttgatgctcctcgtctccctccactgagtactcccttcctctcctcattctcatctcagtcctctcctcctccctcgaataagatagatccgcccttgttgctgatctcatctcgcctcctattggcctcgcccctgccaactgactgctctattggtgaccgtggactttttgggtatatatatttcctgtcgatttgtttccacttaaagtagcaatgcttggatctaaaacttattacttctcctgcttcagattctgatccatttgtgttgattgaactcagggtgggatcgtggggctctgtatctatctaggatggatattccaagcaatttactctcttgagtgctgttggtcttcctctgctcctcgtctccgcttcctctcagtctcctccattgcgctgcctggaacagatcgatccgccttgttgctgatctcatccatcctccgtggagatttcgggtggcagtttccagtgactattcagagcaccatactagtggcctggtaaaaatttccctcccatctttcttgctattctcttcttattaatctgctgatttgcttgatggtaagttcttacttattcttccagatcgagtgaagcgacatccgccgccgtcttgtcccctacgacgccgctgtgttctgctctgtcctcctctgccggtgaagcatcaacggtgacggccatccggtgttgacgccgcggctgtgttctcctctgccgtgaagtatcaaaggtgggtttggatggatatcacagtttggattggcaactctgttctatagctcgttgaaattaaagcttcacacagttttgattggattacagctccccatattcatctattttgcaccatgcatcgaatccactgacctccacacgctcacggatctggcctctggtgcccacacgctcacggatccgacagagtgctcccttcctatcatctcagtcctcatctcctggtcgatccggcttcttgtttggtgagctcgtccaacctccgagctcgcccctgacacctgtggagtggaggtatatttctttccagctgaagtacgcttggatctaaaaacttacgtctcctgcttcactgcttgcttgggagtctgatcgatttgtgttggttgaatcatttggggtggcagtggagcagctagcaagaatcatggagtttccaatcattattcagagcaccacgcatggaatccactgacctggtaactttgtctcatctttcttgctactgaaatcttccacatccccaccttccttgttcatctgctgatttcccagattatacttccagattgagtgaagcgccgtcttgtcccctcacggatctggcctctggtgcccagccgccgctttcgcttcgttgtccgacgaggccaccgccgctgtgttctgctctgccgtgaagcacaaaaaggtggggtcttcctctgctctttctccactgacggcgatccgaccttgacacccgtggccgtggcagtggggtcttcctctgctctgtttttttaccagttattggatctaaaaagggatctaaaagttattacttctcctgcttgagattctgaccgatttgtgttgattgaatccagggtggggtcgtggggctctgtatctatctagtacggagtaccactgtattccaagcaatttactctcttgactgctgttggacttcctctgtccccgcttccattgtgctgccttgaacagatccatccaccttgttgctaatctcatccaacctccgggtatgtttcttgtcgatttgtttccagtaaagtagcaatgcttgggtctaaaaagtcattgcttctcctgcttgacgagtctcattgatttgcccagtcattattcagagcaccatgcatccaaggcgctgacccggctataagtttttattacagggccgccgtgttgtccccatcgagcaaagcgtttaatccactgacccgcttcgttgtccgcacagcgtgaccatccgacgaagacgccgccgttgtgttctgctctcctctgaagcatcaaaaggtgggcttggtccagatccccacattcatcgatttggcttgccaactcagttccaccagagcttggattgtgttacagatccctaaattcatcgatttgcaggtttcagctgattgatcaagagagctctcatggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctagctgacgttgcttcaggtgtgctctcaatctatacatatttactcatcatattattctccacctttttttccatctctagagctcagcttgtcattgcattgttcaattgtgcttctctagcagctacggaaattctgaacaggcaaaggtaattttacagaagtttctttggcataagtatctgagaaaaatgcacttggcacaatttaccttttcgcagtagaaaagagtcagtggatcataccttcttaattgttcgattgctcgtaatacttgggggcactctatgattgctgtgtgcttttagttttgatatagttcctgttagcatggacagactgtgtgattggttcatgaatttcagggtggttctaatgaggaaatgatgcttgcttcagaaatagtttccatttgtacctaagctgtgtagttggtaaagttgcattttggatgttctgttggtatagcttacagaagaaagacttgcgttgtgcaggtaccaggggcgcaggttactgctagtggcgtctgagatgtttcataaacgttgggtgggcaccggtcatgcaaaaaattgaaggataaaaaggttccgagaggttgtgtgatgtgctccttttaaatggcagtcgcttgcataaagagatgttgcttggttttttagtaaagcgttgtagtaagttgctctgtttcggctgagagccatcgttgttgctgtctgttacatcgaatggctggctcatgtcatgttgatgttttttttatctgaaccggacaaacctgagggtgtagtatcatgtttgtaatgactgaaattctgggctcacccgagctccttaattcgtaaacaactgcgactcattgttggattccttacttcagaaaatatttacttgctctggctcatacagctctgcatgttttgtagtggtttgtcgctgtttaggtgctgcttcagactcctggtacctttggccgctgctgctactgcatgagctttgtatggcattgttagtatagtttggtgtcattgggttttcgccccatggtgagtgtccattgcgcgcactcgcagcggtttcctggcgataagttgaacttgatctttctctttcccacctcctaaacgtctattcagacttgtgtatatttgcattacggggattacccgagttcaaaaataaatattatttactagttctgccaatgtgtttccgttacatacaaataaaagggtgcttccagctacaagtatatttttgagaagggccattgcaaaacgaaatgaagcccaaattctaccaacatgtttctgtcacatatacattaaaaaaacggtgtaaatgtcccgtcaaaaaagggtgtatgtaggaaaaggagttcgacgccgccagctccctcctaacgctcagattgtcttcgcggccgcatga

SEQ ID NO: 152 - DNA, 21636 bp, Artificial Sequence
  transformation construct
gtcgacgatcgtcaacgttcacttctaaagaaatagcgccactcagcttcctcagcggctttatccagcgatttcctattatgtcggcatagttctcaagatcgacagcctgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattccaatccccaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagtataagagctctatttttacaacaattaccaacaacaacaaacaacaaacaacattacaattactatttacaattaccatgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcaaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatttgatgacccgggggatcctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggacctgcaggcatgcaagctctagagcggccgcgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggaatgatggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactaactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagaaaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctaggctttgcctaaaccgagatgcgcctttggttatggagcccaagtcacgtactcggattggatgctgcagcaaatgatacttctgtacatgtctgcaagtatcacgaattagtggaatgactaggaataagtaagacaagtatcacgaattcagagtcggatgcaatttttttcttttcttttgggcataagtagattgtcatttgagtatttttttccattaatatttgtgtattcttagattgagactttgatatgtaacccagatttctgttgttaggaaacacataccgtgtagcttatcagaagaaaaagatctagcgtgcatctatattctatcggactatgatatttggcacatgtgtgccatataaacaaaactgtcacacctctatttccttcactctaaatagatgtatacattagtttgattctttcttctttcacgtgcatttctccttctaattagatgcatacattagaggacaaaaaagacgatgtcattctagattttctttattaaaatatttaaaatgttttgtagctcaaaccgtcggtccgatgtaaaaaccgtttttacatatacgattcgtcgcgatgagatctttgaaactagatcctatgttgacatgtttcgatgactttttttaaccaaaatttaccatgccttttatatgcaagttaccgtgctatttccacataagtcatcggaggcataaaaatggttcaccgacactacagttcatatattaccatgatgtttacatataagttaccgggagggggggggggggtgtctgttttcaataatttccccaccgagtcaaatattaccatagtatatgtacgtaagttatcaggtatccgatgggtatattaccatggctatcttttaaaaaaatctctaatttaccgcggtgtttgtatctaaattatcaagtttgtggtgcctaatttactatgctatttacatacaaaagttaccagtgtattttttgacaattttttactattcttccccaaatcaagactattaccgtgctgtttacacacaagttaccgggtatattttcaacaacttcatccacccgaatcaaacttatcatgatgtttgtgagtaacttatcatgtctgcaatgcgtatattaccattctatttaaacaaaatttaccaacgatatgcttcaaacaattttttacgtgggtcaaagctagcatactgtttttgcgtaagttattgtatctgcaataaatatattaccgtgctatttacctagaagttattgggggtaatgttcttcaacgaaaaaaaattcagggtcaaaaaattattgtggtgtttgaacgagagttattagctctccgatgggtaaattatcatgttatttgcacataaattaccgagggtatgcttttcaacaacttcctccatccaggtcaaagttatcatggtgtttttgctcaagttttcaagtttgtggtgcgtatattaccacgatgttgactgtttacaaggtttttgagtcgccgactaatcgccgactaatcgtcgagtcgtcgcggcggcggccgccaccgcggctgagtggctccttcaagcttgcggatccgggcggaaataggtaaagaagttgcggataaggtaattgccattgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgacccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctggcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgtttaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgatatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatgaagatcggcggcaatagcttcttagcgccatcccggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttgggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagatcc

SEQ ID NO: 153 - DNA, 21890 bp, Artificial Sequence
  transformation construct
gtcgacgatcgtcaacgttcacttctaaagaaatagcgccactcagcttcctcagcggctttatccagcgatttcctattatgtcggcatagttctcaagatcgacagcctgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattccaatccccaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagtataagagctctatttttacaacaattaccaacaacaacaaacaacaaacaacattacaattactatttacaattaccatgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcaaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatttgatgacccgggggatcctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggacctgcaggcatgcaagctctagagcggccgctttaagagtgttgaggatgtgcttacttaaatttcaaaagggctatttagggataatatttggtgaagcatggctggtggactgaccataggtacccactgaataaacatatcagcccaaaggcagagggtatccctccctgtaatacgtactagtattcgaggagcgtgctaaagtagtatcctctcttgatgctcctcgtctccctccactgagtactcccttcctctcctcattctcatctcagtcctctcctcctccctcgaataagatagatccgcccttgttgctgatctcatctcgcctcctattggcctcgcccctgccaactgactgctctattggtgaccgtggactttttgggtatatatatttcctgtcgatttgtttccacttaaagtagcaatgcttggatctaaaacttattacttctcctgcttcagattctgatccatttgtgttgattgaactcagggtgggatcgtggggctctgtatctatctaggatggatattccaagcaatttactctcttgagtgctgttggtcttcctctgctcctcgtctccgcttcctctcagtctcctccattgcgctgcctggaacagatcgatccgccttgttgctgatctcatccatcctccgtggagatttcgggtggcagtttccagtgactattcagagcaccatactagtggcctggtaaaaatttccctcccatctttcttgctattctcttcttattaatctgctgatttgcttgatggtaagttcttacttattcttccagatcgagtgaagcgacatccgccgccgtcttgtcccctacgacgccgctgtgttctgctctgtcctcctctgccggtgaagcatcaacggtgacggccatccggtgttgacgccgcggctgtgttctcctctgccgtgaagtatcaaaggtgggtttggatggatatcacagtttggattggcaactctgttctatagctcgttgaaattaaagcttcacacagttttgattggattacagctccccatattcatctattttgcaccatgcatcgaatccactgacctccacacgctcacggatctggcctctggtgcccacacgctcacggatccgacagagtgctcccttcctatcatctcagtcctcatctcctggtcgatccggcttcttgtttggtgagctcgtccaacctccgagctcgcccctgacacctgtggagtggaggtatatttctttccagctgaagtacgcttggatctaaaaacttacgtctcctgcttcactgcttgcttgggagtctgatcgatttgtgttggttgaatcatttggggtggcagtggagcagctagcaagaatcatggagtttccaatcattattcagagcaccacgcatggaatccactgacctggtaactttgtctcatctttcttgctactgaaatcttccacatccccaccttccttgttcatctgctgatttcccagattatacttccagattgagtgaagcgccgtcttgtcccctcacggatctggcctctggtgcccagccgccgctttcgcttcgttgtccgacgaggccaccgccgctgtgttctgctctgccgtgaagcacaaaaaggtggggtcttcctctgctctttctccactgacggcgatccgaccttgacacccgtggccgtggcagtggggtcttcctctgctctgtttttttaccagttattggatctaaaaagggatctaaaagttattacttctcctgcttgagattctgaccgatttgtgttgattgaatccagggtggggtcgtggggctctgtatctatctagtacggagtaccactgtattccaagcaatttactctcttgactgctgttggacttcctctgtccccgcttccattgtgctgccttgaacagatccatccaccttgttgctaatctcatccaacctccgggtatgtttcttgtcgatttgtttccagtaaagtagcaatgcttgggtctaaaaagtcattgcttctcctgcttgacgagtctcattgatttgcccagtcattattcagagcaccatgcatccaaggcgctgacccggctataagtttttattacagggccgccgtgttgtccccatcgagcaaagcgtttaatccactgacccgcttcgttgtccgcacagcgtgaccatccgacgaagacgccgccgttgtgttctgctctcctctgaagcatcaaaaggtgggcttggtccagatccccacattcatcgatttggcttgccaactcagttccaccagagcttggattgtgttacagatccctaaattcatcgatttgcaggtttcagctgattgatcaagagagctctcaatgatggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactaactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagaaaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctaggcttctgacgttgcttcaggtgtgctctcaatctatacatatttactcatcatattattctccacctttttttccatctctagagctcagcttgtcattgcattgttcaattgtgcttctctagcagctacggaaattctgaacaggcaaaggtaattttacagaagtttctttggcataagtatctgagaaaaatgcacttggcacaatttaccttttcgcagtagaaaagagtcagtggatcataccttcttaattgttcgattgctcgtaatacttgggggcactctatgattgctgtgtgcttttagttttgatatagttcctgttagcatggacagactgtgtgattggttcatgaatttcagggtggttctaatgaggaaatgatgcttgcttcagaaatagtttccatttgtacctaagctgtgtagttggtaaagttgcattttggatgttctgttggtatagcttacagaagaaagacttgcgttgtgcaggtaccaggggcgcaggttactgctagtggcgtctgagatgtttcataaacgttgggtgggcaccggtcatgcaaaaaattgaaggataaaaaggttccgagaggttgtgtgatgtgctccttttaaatggcagtcgcttgcataaagagatgttgcttggttttttagtaaagcgttgtagtaagttgctctgtttcggctgagagccatcgttgttgctgtctgttacatcgaatggctggctcatgtcatgttgatgttttttttatctgaaccggacaaacctgagggtgtagtatcatgtttgtaatgactgaaattctgggctcacccgagctccttaattcgtaaacaactgcgactcattgttggattccttacttcagaaaatatttacttgctctggctcatacagctctgcatgttttgtagtggtttgtcgctgtttaggtgctgcttcagactcctggtacctttggccgctgctgctactgcatgagctttgtatggcattgttagtatagtttggtgtcattgggttttcgccccatggtgagtgtccattgcgcgcactcgcagcggtttcctggcgataagttgaacttgatctttctctttcccacctcctaaacgtctattcagacttgtgtatatttgcattacggggattacccgagttcaaaaataaatattatttactagttctgccaatgtgtttccgttacatacaaataaaagggtgcttccagctacaagtatatttttgagaagggccattgcaaaacgaaatgaagcccaaattctaccaacatgtttctgtcacatatacattaaaaaaacggtgtaaatgtcccgtcaaaaaagggtgtatgtaggaaaaggagttcgacgccgccagctccctcctaacgctcagattgtcttcgcggccgccaccgcggctgagtggctccttcaagcttgcggatccgggcggaaataggtaaagaagttgcggataaggtaattgccattgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgacccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctggcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgtttaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgatatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatgaagatcggcggcaatagcttcttagcgccatcccggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttgggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagatcc

SEQ ID NO: 154 - DNA, 22029 bp, Artificial Sequence
  transformation construction
gtcgacgatcgtcaacgttcacttctaaagaaatagcgccactcagcttcctcagcggctttatccagcgatttcctattatgtcggcatagttctcaagatcgacagcctgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattccaatccccaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagtataagagctctatttttacaacaattaccaacaacaacaaacaacaaacaacattacaattactatttacaattaccatgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcaaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatttgatgacccgggggatcctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggacctgcaggcatgcaagctctagagcggccgctttaagagtgttgaggatgtgcttacttaaatttcaaaagggctatttagggataatatttggtgaagcatggctggtggactgaccataggtacccactgaataaacatatcagcccaaaggcagagggtatccctccctgtaatacgtactagtattcgaggagcgtgctaaagtagtatcctctcttgatgctcctcgtctccctccactgagtactcccttcctctcctcattctcatctcagtcctctcctcctccctcgaataagatagatccgcccttgttgctgatctcatctcgcctcctattggcctcgcccctgccaactgactgctctattggtgaccgtggactttttgggtatatatatttcctgtcgatttgtttccacttaaagtagcaatgcttggatctaaaacttattacttctcctgcttcagattctgatccatttgtgttgattgaactcagggtgggatcgtggggctctgtatctatctaggatggatattccaagcaatttactctcttgagtgctgttggtcttcctctgctcctcgtctccgcttcctctcagtctcctccattgcgctgcctggaacagatcgatccgccttgttgctgatctcatccatcctccgtggagatttcgggtggcagtttccagtgactattcagagcaccatactagtggcctggtaaaaatttccctcccatctttcttgctattctcttcttattaatctgctgatttgcttgatggtaagttcttacttattcttccagatcgagtgaagcgacatccgccgccgtcttgtcccctacgacgccgctgtgttctgctctgtcctcctctgccggtgaagcatcaacggtgacggccatccggtgttgacgccgcggctgtgttctcctctgccgtgaagtatcaaaggtgggtttggatggatatcacagtttggattggcaactctgttctatagctcgttgaaattaaagcttcacacagttttgattggattacagctccccatattcatctattttgcaccatgcatcgaatccactgacctccacacgctcacggatctggcctctggtgcccacacgctcacggatccgacagagtgctcccttcctatcatctcagtcctcatctcctggtcgatccggcttcttgtttggtgagctcgtccaacctccgagctcgcccctgacacctgtggagtggaggtatatttctttccagctgaagtacgcttggatctaaaaacttacgtctcctgcttcactgcttgcttgggagtctgatcgatttgtgttggttgaatcatttggggtggcagtggagcagctagcaagaatcatggagtttccaatcattattcagagcaccacgcatggaatccactgacctggtaactttgtctcatctttcttgctactgaaatcttccacatccccaccttccttgttcatctgctgatttcccagattatacttccagattgagtgaagcgccgtcttgtcccctcacggatctggcctctggtgcccagccgccgctttcgcttcgttgtccgacgaggccaccgccgctgtgttctgctctgccgtgaagcacaaaaaggtggggtcttcctctgctctttctccactgacggcgatccgaccttgacacccgtggccgtggcagtggggtcttcctctgctctgtttttttaccagttattggatctaaaaagggatctaaaagttattacttctcctgcttgagattctgaccgatttgtgttgattgaatccagggtggggtcgtggggctctgtatctatctagtacggagtaccactgtattccaagcaatttactctcttgactgctgttggacttcctctgtccccgcttccattgtgctgccttgaacagatccatccaccttgttgctaatctcatccaacctccgggtatgtttcttgtcgatttgtttccagtaaagtagcaatgcttgggtctaaaaagtcattgcttctcctgcttgacgagtctcattgatttgcccagtcattattcagagcaccatgcatccaaggcgctgacccggctataagtttttattacagggccgccgtgttgtccccatcgagcaaagcgtttaatccactgacccgcttcgttgtccgcacagcgtgaccatccgacgaagacgccgccgttgtgttctgctctcctctgaagcatcaaaaggtgggcttggtccagatccccacattcatcgatttggcttgccaactcagttccaccagagcttggattgtgttacagatccctaaattcatcgatttgcaggtttcagctgattgatcaagagagctctcaatgatggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactaactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagaaaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctaggctttgcctaaaccgagatgcgcctttggttatggagcccaagtcacgtactcggattggatgctgcagcaaatgatacttctgtacatgtctgcaagtatcacgaattagtggaatgactaggaataagtaagacaagtatcacgaattcagagtcggatgcaatttttttcttttcttttgggcataagtagattgtcatttgagtatttttttccattaatatttgtgtattcttagattgagactttgatatgtaacccagatttctgttgttaggaaacacataccgtgtagcttatcagaagaaaaagatctagcgtgcatctatattctatcggactatgatatttggcacatgtgtgccatataaacaaaactgtcacacctctatttccttcactctaaatagatgtatacattagtttgattctttcttctttcacgtgcatttctccttctaattagatgcatacattagaggacaaaaaagacgatgtcattctagattttctttattaaaatatttaaaatgttttgtagctcaaaccgtcggtccgatgtaaaaaccgtttttacatatacgattcgtcgcgatgagatctttgaaactagatcctatgttgacatgtttcgatgactttttttaaccaaaatttaccatgccttttatatgcaagttaccgtgctatttccacataagtcatcggaggcataaaaatggttcaccgacactacagttcatatattaccatgatgtttacatataagttaccgggagggggggggggggtgtctgttttcaataatttccccaccgagtcaaatattaccatagtatatgtacgtaagttatcaggtatccgatgggtatattaccatggctatcttttaaaaaaatctctaatttaccgcggtgtttgtatctaaattatcaagtttgtggtgcctaatttactatgctatttacatacaaaagttaccagtgtattttttgacaattttttactattcttccccaaatcaagactattaccgtgctgtttacacacaagttaccgggtatattttcaacaacttcatccacccgaatcaaacttatcatgatgtttgtgagtaacttatcatgtctgcaatgcgtatattaccattctatttaaacaaaatttaccaacgatatgcttcaaacaattttttacgtgggtcaaagctagcatactgtttttgcgtaagttattgtatctgcaataaatatattaccgtgctatttacctagaagttattgggggtaatgttcttcaacgaaaaaaaattcagggtcaaaaaattattgtggtgtttgaacgagagttattagctctccgatgggtaaattatcatgttatttgcacataaattaccgagggtatgcttttcaacaacttcctccatccaggtcaaagttatcatggtgtttttgctcaagttttcaagtttgtggtgcgtatattaccacgatgttgactgtttacaaggtttttgagtcgccgactaatcgccgactaatcgtcgagtcgtcgcggcggcggccgccaccgcggctgagtggctccttcaagcttgcggatccgggcggaaataggtaaagaagttgcggataaggtaattgccattgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgacccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctggcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgtttaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgatatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatgaagatcggcggcaatagcttcttagcgccatcccggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttgggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagatcc

SEQ ID NO: 155 - DNA, 21880 bp, Artificial Sequence
  transformation construct
gtcgacgatcgtcaacgttcacttctaaagaaatagcgccactcagcttcctcagcggctttatccagcgatttcctattatgtcggcatagttctcaagatcgacagcctgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattccaatccccaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagtataagagctctatttttacaacaattaccaacaacaacaaacaacaaacaacattacaattactatttacaattaccatgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcaaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatttgatgacccgggggatcctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggacctgcaggcatgcaagctctagagcggccgctttaagagtgttgaggatgtgcttacttaaatttcaaaagggctatttagggataatatttggtgaagcatggctggtggactgaccataggtacccactgaataaacatatcagcccaaaggcagagggtatccctccctgtaatacgtactagtattcgaggagcgtgctaaagtagtatcctctcttgatgctcctcgtctccctccactgagtactcccttcctctcctcattctcatctcagtcctctcctcctccctcgaataagatagatccgcccttgttgctgatctcatctcgcctcctattggcctcgcccctgccaactgactgctctattggtgaccgtggactttttgggtatatatatttcctgtcgatttgtttccacttaaagtagcaatgcttggatctaaaacttattacttctcctgcttcagattctgatccatttgtgttgattgaactcagggtgggatcgtggggctctgtatctatctaggatggatattccaagcaatttactctcttgagtgctgttggtcttcctctgctcctcgtctccgcttcctctcagtctcctccattgcgctgcctggaacagatcgatccgccttgttgctgatctcatccatcctccgtggagatttcgggtggcagtttccagtgactattcagagcaccatactagtggcctggtaaaaatttccctcccatctttcttgctattctcttcttattaatctgctgatttgcttgatggtaagttcttacttattcttccagatcgagtgaagcgacatccgccgccgtcttgtcccctacgacgccgctgtgttctgctctgtcctcctctgccggtgaagcatcaacggtgacggccatccggtgttgacgccgcggctgtgttctcctctgccgtgaagtatcaaaggtgggtttggatggatatcacagtttggattggcaactctgttctatagctcgttgaaattaaagcttcacacagttttgattggattacagctccccatattcatctattttgcaccatgcatcgaatccactgacctccacacgctcacggatctggcctctggtgcccacacgctcacggatccgacagagtgctcccttcctatcatctcagtcctcatctcctggtcgatccggcttcttgtttggtgagctcgtccaacctccgagctcgcccctgacacctgtggagtggaggtatatttctttccagctgaagtacgcttggatctaaaaacttacgtctcctgcttcactgcttgcttgggagtctgatcgatttgtgttggttgaatcatttggggtggcagtggagcagctagcaagaatcatggagtttccaatcattattcagagcaccacgcatggaatccactgacctggtaactttgtctcatctttcttgctactgaaatcttccacatccccaccttccttgttcatctgctgatttcccagattatacttccagattgagtgaagcgccgtcttgtcccctcacggatctggcctctggtgcccagccgccgctttcgcttcgttgtccgacgaggccaccgccgctgtgttctgctctgccgtgaagcacaaaaaggtggggtcttcctctgctctttctccactgacggcgatccgaccttgacacccgtggccgtggcagtggggtcttcctctgctctgtttttttaccagttattggatctaaaaagggatctaaaagttattacttctcctgcttgagattctgaccgatttgtgttgattgaatccagggtggggtcgtggggctctgtatctatctagtacggagtaccactgtattccaagcaatttactctcttgactgctgttggacttcctctgtccccgcttccattgtgctgccttgaacagatccatccaccttgttgctaatctcatccaacctccgggtatgtttcttgtcgatttgtttccagtaaagtagcaatgcttgggtctaaaaagtcattgcttctcctgcttgacgagtctcattgatttgcccagtcattattcagagcaccatgcatccaaggcgctgacccggctataagtttttattacagggccgccgtgttgtccccatcgagcaaagcgtttaatccactgacccgcttcgttgtccgcacagcgtgaccatccgacgaagacgccgccgttgtgttctgctctcctctgaagcatcaaaaggtgggcttggtccagatccccacattcatcgatttggcttgccaactcagttccaccagagcttggattgtgttacagatccctaaattcatcgatttgcaggtttcagctgattgatcaagagagctctcaatgatggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtaccagatcttgttctctttacagtactattagtacctaccatcagatttgtgaccgatttgttgccactcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcgcaaatcaccaagaaagacgaggcttgctctagattagatgatatacaactcatcatcgacaagattcgagaattcctccaagacacaaggtatgtatgtgagatctactacgaagtaacattgcttaattagctcatgcataatccgttgcctagaattttgctaatgagattgctttgtgtgatttactttcgtcctcaacttgtatgactgcgcttaaactttcaagtcattgtttcttgcaacttatgtcgatctgttcactaattaagatatagctaaaatgtgtttgccaatttctgtcgccacacattttctaatttgattgccacaggtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactaactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagaaaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacgggttgcttttggacaatccgaagatagagcagcaggatattgagatgattggattgatacccaatctgatcgatttgacactgtatttacgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctaccacttcatcgaaaagcccaaatctggtgcggtcgatttcgactttggcatccaacacctctccagccttgctcgcctcactgtcggcttattatgcgttggctcgacggcggcggaagtagaggctgcggaggatgctttcaagagcatggccgaggcgaaccccaaccgtccaatactggagatgacaagactttatccgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctaggcttctgacgttgcttcaggtgtgctctcaatctatacatatttactcatcatattattctccacctttttttccatctctagagctcagcttgtcattgcattgttcaattgtgcttctctagcagctacggaaattctgaacaggcaaaggtaattttacagaagtttctttggcataagtatctgagaaaaatgcacttggcacaatttaccttttcgcagtagaaaagagtcagtggatcataccttcttaattgttcgattgctcgtaatacttgggggcactctatgattgctgtgtgcttttagttttgatatagttcctgttagcatggacagactgtgtgattggttcatgaatttcagggtggttctaatgaggaaatgatgcttgcttcagaaatagtttccatttgtacctaagctgtgtagttggtaaagttgcattttggatgttctgttggtatagcttacagaagaaagacttgcgttgtgcaggtaccaggggcgcaggttactgctagtggcgtctgagatgtttcataaacgttgggtgggcaccggtcatgcaaaaaattgaaggataaaaaggttccgagaggttgtgtgatgtgctccttttaaatggcagtcgcttgcataaagagatgttgcttggttttttagtaaagcgttgtagtaagttgctctgtttcggctgagagccatcgttgttgctgtctgttacatcgaatggctggctcatgtcatgttgatgttttttttatctgaaccggacaaacctgagggtgtagtatcatgtttgtaatgactgaaattctgggctcacccgagctccttaattcgtaaacaactgcgactcattgttggattccttacttcagaaaatatttacttgctctggctcatacagctctgcatgttttgtagtggtttgtcgctgtttaggtgctgcttcagactcctggtacctttggccgctgctgctactgcatgagctttgtatggcattgttagtatagtttggtgtcattgggttttcgccccatggtgagtgtccattgcgcgcactcgcagcggtttcctggcgataagttgaacttgatctttctctttcccacctcctaaacgtctattcagacttgtgtatatttgcattacggggattacccgagttcaaaaataaatattatttactagttctgccaatgtgtttccgttacatacaaataaaagggtgcttccagctacaagtatatttttgagaagggccattgcaaaacgaaatgaagcccaaattctaccaacatgtttctgtcacatatacattaaaaaaacggtgtaaatgtcccgtcaaaaaagggtgtatgtaggaaaaggagttcgacgccgccagctccctcctaacgctcagattgtcttcgcggccgccaccgcggctgagtggctccttcaagcttgcggatccgggcggaaataggtaaagaagttgcggataaggtaattgccattgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgacccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctggcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgtttaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgatatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatgaagatcggcggcaatagcttcttagcgccatcccggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttgggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagatcc

SEQ ID NO: 156 - DNA, 21633 bp, Artificial Sequence
  transformation construct
gtcgacgatcgtcaacgttcacttctaaagaaatagcgccactcagcttcctcagcggctttatccagcgatttcctattatgtcggcatagttctcaagatcgacagcctgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattccaatccccaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagtataagagctctatttttacaacaattaccaacaacaacaaacaacaaacaacattacaattactatttacaattaccatgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcaaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatttgatgacccgggggatcctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggacctgcaggcatgcaagctctagagcggccgcgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggaatgatggcggaagttctggtgagcgcatccacaggcgcaatgggttccctcctccggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtaccagatcttgttctctttacagtactattagtacctaccatcagatttgtgaccgatttgttgccactcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccatcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagttggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccatggcagtgagacgcggtactcccggtggtactaactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcggcattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcttgttggtcacaacaagggaaacaaaagaagagtgggatcgggtgcgacattcaatacgctcttcaaaggtcaaaagtgatataatagaaaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcggagtattgccgagtccatgacaccatccttgatttcctaattgacaaatcctctgaagagaacatgtgtactgtcctgaagaaacaatgcaagcctaatggcatagttcgtcggctctctctaatggggaatgaggatgaagaaatcatggagcaattggatctgtcacacgctcggtcaatcagtgcttttggggatatcaagctattgccttcgcttgggaggtcaaaatgcttgcgcgtgctagacttgcaaggctgctatcagttgaaaaatcatcatatcaaggatattgaaagactctatcagctgagatacttggatatctcttttacaggaatcacggagcttcccaggcaaattggggagttgctgtatctagagacgctagttagtacatcctatggattacgtgagcttcctgaaagcacaagtcggctacaacgactggcacgtttgtttgttgacagcggttgtaagcttccagatgggttgggaaacttgataaacttgcaagagcttgactgcgttgatgccttgcagttgaagcatgtggaagagctcggcaaactaacaaatctgagaaagctgaggattaaattggacactgatgggattgaaggcaacaaattagaacagtccaaggaaaagctggtgtcctctctctgtaaactggacgaatgcggcctcctttccctgagtatttattattatctgagagaaaaggatggagaagagccgttcctccctgctttgggttgtatccaggaggtttttgtacatggacaagatatcagccggattagcagatggctcgcgtcacttcccaacctacacaggttgtttttgaaccaaccgaagatagagcagcaggatattgagatgattggattgatacccaatctgatggatttgacactgtatttatgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctacgacttcatcggaaagcccaaatctggtgcggtcgatttcgactttggcatccaacacctctccagccttgctcgcctcactgtcggcttatcctgcgttggctcgacggtggcggaagtagaggccgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcggtagatcaaaagatgtgcatatgcttcaatcttttttccggtaatctatttcagctacaacgccggccgtcaagtcctaggctttgcctaaaccgagatgcgcctttggttatggagcccaagtcacgtactcggattggatgctgcagcaaatgatacttctgtacatgtctgcaagtatcacgaattagtggaatgactaggaataagtaagacaagtatcacgaattcagagtcggatgcaatttttttcttttcttttgggcataagtagattgtcatttgagtatttttttccattaatatttgtgtattcttagattgagactttgatatgtaacccagatttctgttgttaggaaacacataccgtgtagcttatcagaagaaaaagatctagcgtgcatctatattctatcggactatgatatttggcacatgtgtgccatataaacaaaactgtcacacctctatttccttcactctaaatagatgtatacattagtttgattctttcttctttcacgtgcatttctccttctaattagatgcatacattagaggacaaaaaagacgatgtcattctagattttctttattaaaatatttaaaatgttttgtagctcaaaccgtcggtccgatgtaaaaaccgtttttacatatacgattcgtcgcgatgagatctttgaaactagatcctatgttgacatgtttcgatgactttttttaaccaaaatttaccatgccttttatatgcaagttaccgtgctatttccacataagtcatcggaggcataaaaatggttcaccgacactacagttcatatattaccatgatgtttacatataagttaccgggagggggggggggggtgtctgttttcaataatttccccaccgagtcaaatattaccatagtatatgtacgtaagttatcaggtatccgatgggtatattaccatggctatcttttaaaaaaatctctaatttaccgcggtgtttgtatctaaattatcaagtttgtggtgcctaatttactatgctatttacatacaaaagttaccagtgtattttttgacaattttttactattcttccccaaatcaagactattaccgtgctgtttacacacaagttaccgggtatattttcaacaacttcatccacccgaatcaaacttatcatgatgtttgtgagtaacttatcatgtctgcaatgcgtatattaccattctatttaaacaaaatttaccaacgatatgcttcaaacaattttttacgtgggtcaaagctagcatactgtttttgcgtaagttattgtatctgcaataaatatattaccgtgctatttacctagaagttattgggggtaatgttcttcaacgaaaaaaaattcagggtcaaaaaattattgtggtgtttgaacgagagttattagctctccgatgggtaaattatcatgttatttgcacataaattaccgagggtatgcttttcaacaacttcctccatccaggtcaaagttatcatggtgtttttgctcaagttttcaagtttgtggtgcgtatattaccacgatgttgactgtttacaaggtttttgagtcgccgactaatcgccgactaatcgtcgagtcgtcgcggcggcggccgccaccgcggctgagtggctccttcaagcttgcggatccgggcggaaataggtaaagaagttgcggataaggtaattgccattgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgacccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctggcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgtttaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgatatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatgaagatcggcggcaatagcttcttagcgccatcccggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttgggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagatcc

SEQ ID NO: 157 - DNA, 21878 bp, Artificial Sequence
  transformation construct
gtcgacgatcgtcaacgttcacttctaaagaaatagcgccactcagcttcctcagcggctttatccagcgatttcctattatgtcggcatagttctcaagatcgacagcctgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattccaatccccaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagtataagagctctatttttacaacaattaccaacaacaacaaacaacaaacaacattacaattactatttacaattaccatgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcaaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatttgatgacccgggggatcctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggacctgcaggcatgcaagctctagagcggccgctttaagagtgttgaggatgtgcttacttaaatttcaaaagggctatttagggataatatttggtgaagcatggctggtggactgaccataggtacccactgaataaacatatcagcccaaaggcagagggtatccctccctgtaatacgtactagtattcgaggagcgtgctaaagtagtatcctctcttgatgctcctcgtctccctccactgagtactcccttcctctcctcattctcatctcagtcctctcctcctccctcgaataagatagatccgcccttgttgctgatctcatctcgcctcctattggcctcgcccctgccaactgactgctctattggtgaccgtggactttttgggtatatatatttcctgtcgatttgtttccacttaaagtagcaatgcttggatctaaaacttattacttctcctgcttcagattctgatccatttgtgttgattgaactcagggtgggatcgtggggctctgtatctatctaggatggatattccaagcaatttactctcttgagtgctgttggtcttcctctgctcctcgtctccgcttcctctcagtctcctccattgcgctgcctggaacagatcgatccgccttgttgctgatctcatccatcctccgtggagatttcgggtggcagtttccagtgactattcagagcaccatactagtggcctggtaaaaatttccctcccatctttcttgctattctcttcttattaatctgctgatttgcttgatggtaagttcttacttattcttccagatcgagtgaagcgacatccgccgccgtcttgtcccctacgacgccgctgtgttctgctctgtcctcctctgccggtgaagcatcaacggtgacggccatccggtgttgacgccgcggctgtgttctcctctgccgtgaagtatcaaaggtgggtttggatggatatcacagtttggattggcaactctgttctatagctcgttgaaattaaagcttcacacagttttgattggattacagctccccatattcatctattttgcaccatgcatcgaatccactgacctccacacgctcacggatctggcctctggtgcccacacgctcacggatccgacagagtgctcccttcctatcatctcagtcctcatctcctggtcgatccggcttcttgtttggtgagctcgtccaacctccgagctcgcccctgacacctgtggagtggaggtatatttctttccagctgaagtacgcttggatctaaaaacttacgtctcctgcttcactgcttgcttgggagtctgatcgatttgtgttggttgaatcatttggggtggcagtggagcagctagcaagaatcatggagtttccaatcattattcagagcaccacgcatggaatccactgacctggtaactttgtctcatctttcttgctactgaaatcttccacatccccaccttccttgttcatctgctgatttcccagattatacttccagattgagtgaagcgccgtcttgtcccctcacggatctggcctctggtgcccagccgccgctttcgcttcgttgtccgacgaggccaccgccgctgtgttctgctctgccgtgaagcacaaaaaggtggggtcttcctctgctctttctccactgacggcgatccgaccttgacacccgtggccgtggcagtggggtcttcctctgctctgtttttttaccagttattggatctaaaaagggatctaaaagttattacttctcctgcttgagattctgaccgatttgtgttgattgaatccagggtggggtcgtggggctctgtatctatctagtacggagtaccactgtattccaagcaatttactctcttgactgctgttggacttcctctgtccccgcttccattgtgctgccttgaacagatccatccaccttgttgctaatctcatccaacctccgggtatgtttcttgtcgatttgtttccagtaaagtagcaatgcttgggtctaaaaagtcattgcttctcctgcttgacgagtctcattgatttgcccagtcattattcagagcaccatgcatccaaggcgctgacccggctataagtttttattacagggccgccgtgttgtccccatcgagcaaagcgtttaatccactgacccgcttcgttgtccgcacagcgtgaccatccgacgaagacgccgccgttgtgttctgctctcctctgaagcatcaaaaggtgggcttggtccagatccccacattcatcgatttggcttgccaactcagttccaccagagcttggattgtgttacagatccctaaattcatcgatttgcaggtttcagctgattgatcaagagagctctcatggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctagctgacgttgcttcaggtgtgctctcaatctatacatatttactcatcatattattctccacctttttttccatctctagagctcagcttgtcattgcattgttcaattgtgcttctctagcagctacggaaattctgaacaggcaaaggtaattttacagaagtttctttggcataagtatctgagaaaaatgcacttggcacaatttaccttttcgcagtagaaaagagtcagtggatcataccttcttaattgttcgattgctcgtaatacttgggggcactctatgattgctgtgtgcttttagttttgatatagttcctgttagcatggacagactgtgtgattggttcatgaatttcagggtggttctaatgaggaaatgatgcttgcttcagaaatagtttccatttgtacctaagctgtgtagttggtaaagttgcattttggatgttctgttggtatagcttacagaagaaagacttgcgttgtgcaggtaccaggggcgcaggttactgctagtggcgtctgagatgtttcataaacgttgggtgggcaccggtcatgcaaaaaattgaaggataaaaaggttccgagaggttgtgtgatgtgctccttttaaatggcagtcgcttgcataaagagatgttgcttggttttttagtaaagcgttgtagtaagttgctctgtttcggctgagagccatcgttgttgctgtctgttacatcgaatggctggctcatgtcatgttgatgttttttttatctgaaccggacaaacctgagggtgtagtatcatgtttgtaatgactgaaattctgggctcacccgagctccttaattcgtaaacaactgcgactcattgttggattccttacttcagaaaatatttacttgctctggctcatacagctctgcatgttttgtagtggtttgtcgctgtttaggtgctgcttcagactcctggtacctttggccgctgctgctactgcatgagctttgtatggcattgttagtatagtttggtgtcattgggttttcgccccatggtgagtgtccattgcgcgcactcgcagcggtttcctggcgataagttgaacttgatctttctctttcccacctcctaaacgtctattcagacttgtgtatatttgcattacggggattacccgagttcaaaaataaatattatttactagttctgccaatgtgtttccgttacatacaaataaaagggtgcttccagctacaagtatatttttgagaagggccattgcaaaacgaaatgaagcccaaattctaccaacatgtttctgtcacatatacattaaaaaaacggtgtaaatgtcccgtcaaaaaagggtgtatgtaggaaaaggagttcgacgccgccagctccctcctaacgctcagattgtcttcgcggccgccaccgcggctgagtggctccttcaagcttgcggatccgggcggaaataggtaaagaagttgcggataaggtaattgccattgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgacccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctggcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgtttaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgatatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatgaagatcggcggcaatagcttcttagcgccatcccggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttgggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagatcc

SEQ ID NO: 158 - DNA, 21887 bp, Artificial Sequence
  transformation construct
gtcgacgatcgtcaacgttcacttctaaagaaatagcgccactcagcttcctcagcggctttatccagcgatttcctattatgtcggcatagttctcaagatcgacagcctgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattccaatccccaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagtataagagctctatttttacaacaattaccaacaacaacaaacaacaaacaacattacaattactatttacaattaccatgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcaaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatttgatgacccgggggatcctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggacctgcaggcatgcaagctctagagcggccgctttaagagtgttgaggatgtgcttacttaaatttcaaaagggctatttagggataatatttggtgaagcatggctggtggactgaccataggtacccactgaataaacatatcagcccaaaggcagagggtatccctccctgtaatacgtactagtattcgaggagcgtgctaaagtagtatcctctcttgatgctcctcgtctccctccactgagtactcccttcctctcctcattctcatctcagtcctctcctcctccctcgaataagatagatccgcccttgttgctgatctcatctcgcctcctattggcctcgcccctgccaactgactgctctattggtgaccgtggactttttgggtatatatatttcctgtcgatttgtttccacttaaagtagcaatgcttggatctaaaacttattacttctcctgcttcagattctgatccatttgtgttgattgaactcagggtgggatcgtggggctctgtatctatctaggatggatattccaagcaatttactctcttgagtgctgttggtcttcctctgctcctcgtctccgcttcctctcagtctcctccattgcgctgcctggaacagatcgatccgccttgttgctgatctcatccatcctccgtggagatttcgggtggcagtttccagtgactattcagagcaccatactagtggcctggtaaaaatttccctcccatctttcttgctattctcttcttattaatctgctgatttgcttgatggtaagttcttacttattcttccagatcgagtgaagcgacatccgccgccgtcttgtcccctacgacgccgctgtgttctgctctgtcctcctctgccggtgaagcatcaacggtgacggccatccggtgttgacgccgcggctgtgttctcctctgccgtgaagtatcaaaggtgggtttggatggatatcacagtttggattggcaactctgttctatagctcgttgaaattaaagcttcacacagttttgattggattacagctccccatattcatctattttgcaccatgcatcgaatccactgacctccacacgctcacggatctggcctctggtgcccacacgctcacggatccgacagagtgctcccttcctatcatctcagtcctcatctcctggtcgatccggcttcttgtttggtgagctcgtccaacctccgagctcgcccctgacacctgtggagtggaggtatatttctttccagctgaagtacgcttggatctaaaaacttacgtctcctgcttcactgcttgcttgggagtctgatcgatttgtgttggttgaatcatttggggtggcagtggagcagctagcaagaatcatggagtttccaatcattattcagagcaccacgcatggaatccactgacctggtaactttgtctcatctttcttgctactgaaatcttccacatccccaccttccttgttcatctgctgatttcccagattatacttccagattgagtgaagcgccgtcttgtcccctcacggatctggcctctggtgcccagccgccgctttcgcttcgttgtccgacgaggccaccgccgctgtgttctgctctgccgtgaagcacaaaaaggtggggtcttcctctgctctttctccactgacggcgatccgaccttgacacccgtggccgtggcagtggggtcttcctctgctctgtttttttaccagttattggatctaaaaagggatctaaaagttattacttctcctgcttgagattctgaccgatttgtgttgattgaatccagggtggggtcgtggggctctgtatctatctagtacggagtaccactgtattccaagcaatttactctcttgactgctgttggacttcctctgtccccgcttccattgtgctgccttgaacagatccatccaccttgttgctaatctcatccaacctccgggtatgtttcttgtcgatttgtttccagtaaagtagcaatgcttgggtctaaaaagtcattgcttctcctgcttgacgagtctcattgatttgcccagtcattattcagagcaccatgcatccaaggcgctgacccggctataagtttttattacagggccgccgtgttgtccccatcgagcaaagcgtttaatccactgacccgcttcgttgtccgcacagcgtgaccatccgacgaagacgccgccgttgtgttctgctctcctctgaagcatcaaaaggtgggcttggtccagatccccacattcatcgatttggcttgccaactcagttccaccagagcttggattgtgttacagatccctaaattcatcgatttgcaggtttcagctgattgatcaagagagctctcaatgatggcggaagttctggtgagcgcatccacaggcgcaatgggttccctcctccggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtaccagatcttgttctctttacagtactattagtacctaccatcagatttgtgaccgatttgttgccactcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccatcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagttggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccatggcagtgagacgcggtactcccggtggtactaactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcggcattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcttgttggtcacaacaagggaaacaaaagaagagtgggatcgggtgcgacattcaatacgctcttcaaaggtcaaaagtgatataatagaaaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcggagtattgccgagtccatgacaccatccttgatttcctaattgacaaatcctctgaagagaacatgtgtactgtcctgaagaaacaatgcaagcctaatggcatagttcgtcggctctctctaatggggaatgaggatgaagaaatcatggagcaattggatctgtcacacgctcggtcaatcagtgcttttggggatatcaagctattgccttcgcttgggaggtcaaaatgcttgcgcgtgctagacttgcaaggctgctatcagttgaaaaatcatcatatcaaggatattgaaagactctatcagctgagatacttggatatctcttttacaggaatcacggagcttcccaggcaaattggggagttgctgtatctagagacgctagttagtacatcctatggattacgtgagcttcctgaaagcacaagtcggctacaacgactggcacgtttgtttgttgacagcggttgtaagcttccagatgggttgggaaacttgataaacttgcaagagcttgactgcgttgatgccttgcagttgaagcatgtggaagagctcggcaaactaacaaatctgagaaagctgaggattaaattggacactgatgggattgaaggcaacaaattagaacagtccaaggaaaagctggtgtcctctctctgtaaactggacgaatgcggcctcctttccctgagtatttattattatctgagagaaaaggatggagaagagccgttcctccctgctttgggttgtatccaggaggtttttgtacatggacaagatatcagccggattagcagatggctcgcgtcacttcccaacctacacaggttgtttttgaaccaaccgaagatagagcagcaggatattgagatgattggattgatacccaatctgatggatttgacactgtatttatgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctacgacttcatcggaaagcccaaatctggtgcggtcgatttcgactttggcatccaacacctctccagccttgctcgcctcactgtcggcttatcctgcgttggctcgacggtggcggaagtagaggccgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcggtagatcaaaagatgtgcatatgcttcaatcttttttccggtaatctatttcagctacaacgccggccgtcaagtcctaggcttctgacgttgcttcaggtgtgctctcaatctatacatatttactcatcatattattctccacctttttttccatctctagagctcagcttgtcattgcattgttcaattgtgcttctctagcagctacggaaattctgaacaggcaaaggtaattttacagaagtttctttggcataagtatctgagaaaaatgcacttggcacaatttaccttttcgcagtagaaaagagtcagtggatcataccttcttaattgttcgattgctcgtaatacttgggggcactctatgattgctgtgtgcttttagttttgatatagttcctgttagcatggacagactgtgtgattggttcatgaatttcagggtggttctaatgaggaaatgatgcttgcttcagaaatagtttccatttgtacctaagctgtgtagttggtaaagttgcattttggatgttctgttggtatagcttacagaagaaagacttgcgttgtgcaggtaccaggggcgcaggttactgctagtggcgtctgagatgtttcataaacgttgggtgggcaccggtcatgcaaaaaattgaaggataaaaaggttccgagaggttgtgtgatgtgctccttttaaatggcagtcgcttgcataaagagatgttgcttggttttttagtaaagcgttgtagtaagttgctctgtttcggctgagagccatcgttgttgctgtctgttacatcgaatggctggctcatgtcatgttgatgttttttttatctgaaccggacaaacctgagggtgtagtatcatgtttgtaatgactgaaattctgggctcacccgagctccttaattcgtaaacaactgcgactcattgttggattccttacttcagaaaatatttacttgctctggctcatacagctctgcatgttttgtagtggtttgtcgctgtttaggtgctgcttcagactcctggtacctttggccgctgctgctactgcatgagctttgtatggcattgttagtatagtttggtgtcattgggttttcgccccatggtgagtgtccattgcgcgcactcgcagcggtttcctggcgataagttgaacttgatctttctctttcccacctcctaaacgtctattcagacttgtgtatatttgcattacggggattacccgagttcaaaaataaatattatttactagttctgccaatgtgtttccgttacatacaaataaaagggtgcttccagctacaagtatatttttgagaagggccattgcaaaacgaaatgaagcccaaattctaccaacatgtttctgtcacatatacattaaaaaaacggtgtaaatgtcccgtcaaaaaagggtgtatgtaggaaaaggagttcgacgccgccagctccctcctaacgctcagattgtcttcgcggccgccaccgcggctgagtggctccttcaagcttgcggatccgggcggaaataggtaaagaagttgcggataaggtaattgccattgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgacccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctggcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgtttaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgatatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatgaagatcggcggcaatagcttcttagcgccatcccggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttgggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagatcc

SEQ ID NO: 159 - DNA, 20056 bp, Artificial Sequence
  transformation construct
gtcgacgatcgtcaacgttcacttctaaagaaatagcgccactcagcttcctcagcggctttatccagcgatttcctattatgtcggcatagttctcaagatcgacagcctgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattccaatccccaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagtataagagctctatttttacaacaattaccaacaacaacaaacaacaaacaacattacaattactatttacaattaccatgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcaaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatttgatgacccgggggatcctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggacctgcaggcatgcaagctctagagcggccgctttaagagtgttgaggatgtgcttacttaaatttcaaaagggctatttagggataatatttggtgaagcatggctggtggactgaccataggtacccactgaataaacatatcagcccaaaggcagagggtatccctccctgtaatacgtactagtattcgaggagcgtgctaaagtagtatcctctcttgatgctcctcgtctccctccactgagtactcccttcctctcctcattctcatctcagtcctctcctcctccctcgaataagatagatccgcccttgttgctgatctcatctcgcctcctattggcctcgcccctgccaactgactgctctattggtgaccgtggactttttgggtatatatatttcctgtcgatttgtttccacttaaagtagcaatgcttggatctaaaacttattacttctcctgcttcagattctgatccatttgtgttgattgaactcagggtgggatcgtggggctctgtatctatctaggatggatattccaagcaatttactctcttgagtgctgttggtcttcctctgctcctcgtctccgcttcctctcagtctcctccattgcgctgcctggaacagatcgatccgccttgttgctgatctcatccatcctccgtggagatttcgggtggcagtttccagtgactattcagagcaccatactagtggcctggtaaaaatttccctcccatctttcttgctattctcttcttattaatctgctgatttgcttgatggtaagttcttacttattcttccagatcgagtgaagcgacatccgccgccgtcttgtcccctacgacgccgctgtgttctgctctgtcctcctctgccggtgaagcatcaacggtgacggccatccggtgttgacgccgcggctgtgttctcctctgccgtgaagtatcaaaggtgggtttggatggatatcacagtttggattggcaactctgttctatagctcgttgaaattaaagcttcacacagttttgattggattacagctccccatattcatctattttgcaccatgcatcgaatccactgacctccacacgctcacggatctggcctctggtgcccacacgctcacggatccgacagagtgctcccttcctatcatctcagtcctcatctcctggtcgatccggcttcttgtttggtgagctcgtccaacctccgagctcgcccctgacacctgtggagtggaggtatatttctttccagctgaagtacgcttggatctaaaaacttacgtctcctgcttcactgcttgcttgggagtctgatcgatttgtgttggttgaatcatttggggtggcagtggagcagctagcaagaatcatggagtttccaatcattattcagagcaccacgcatggaatccactgacctggtaactttgtctcatctttcttgctactgaaatcttccacatccccaccttccttgttcatctgctgatttcccagattatacttccagattgagtgaagcgccgtcttgtcccctcacggatctggcctctggtgcccagccgccgctttcgcttcgttgtccgacgaggccaccgccgctgtgttctgctctgccgtgaagcacaaaaaggtggggtcttcctctgctctttctccactgacggcgatccgaccttgacacccgtggccgtggcagtggggtcttcctctgctctgtttttttaccagttattggatctaaaaagggatctaaaagttattacttctcctgcttgagattctgaccgatttgtgttgattgaatccagggtggggtcgtggggctctgtatctatctagtacggagtaccactgtattccaagcaatttactctcttgactgctgttggacttcctctgtccccgcttccattgtgctgccttgaacagatccatccaccttgttgctaatctcatccaacctccgggtatgtttcttgtcgatttgtttccagtaaagtagcaatgcttgggtctaaaaagtcattgcttctcctgcttgacgagtctcattgatttgcccagtcattattcagagcaccatgcatccaaggcgctgacccggctataagtttttattacagggccgccgtgttgtccccatcgagcaaagcgtttaatccactgacccgcttcgttgtccgcacagcgtgaccatccgacgaagacgccgccgttgtgttctgctctcctctgaagcatcaaaaggtgggcttggtccagatccccacattcatcgatttggcttgccaactcagttccaccagagcttggattgtgttacagatccctaaattcatcgatttgcaggtttcagctgattgatcaagagagctctcaatgatggcggagtttgtagtcaggccactggtatccacgttgatgaacacggcatccagctacctgctggaccagtacaaggtgatggatggcatgaaggagcagcgcgaaaccctcaagcgccagctgccagccatcttggacatcatccaagatgcggagaagaaaggagcttccctacctggagtgcgcgcttggctcgaagcactcaagaaggtggcctatgaggcgaacgatgtctttgatgagttcaagtacgaggccctccggcgtgacgccaagaagaagggacactacaagaagcttggctttgacatcgtaagcctcttccctgctcacaaccccattgtatttcgttacaggatgggcaagaagttgtgcaggattgtgcgcaaaattgagggccttgtcagagagatgaatgacttcggattcaaccaaactcagcaagcaccaccatccaagcagtggcgcaacacagattccataataattgactctgagaaggatattgtcagcaggtccagaaacgaagagaagaagaagatcgttgatatattgattgatcaagctggcgatagggacctcatcgtccttcccattgttggaatgggcgggctgggcaagaccacctttgctcagcttgtctacaatgaccctataatcaaggagcatttcaagctccagaggtggtgttgtgtgtcagatgattttgatgttgtgaagattgcaaacaacatctgtgagactaatgagatccatcgtgaaaaggcattgcagaaccttcagaaagaagtaagtgggaagagatacctcattgtgttggatgatgtatggaatgaagatgctgataagtgggaaaaactgaaaacctgcctgaagcacggtgggaaggggagtgcaatattgacgaccactcgcaatgtgcaagtagcacgaattatgaagatgtgtattgctgatagccataatctcagaaatctagataaagtatttctgaaggaaatatttgagaatagagcattctgtttgcaaaagccaaaggctgctgagctaagcgatgtggttgataagattatggacagatgtggaggctctcctttagctgccaaagcctttgggtctatgttgagtaacaagactagcatgaaagaatggacagacatactagccagaagcaacacttgcaatgagggcacaaaaacttttcttgtactcaagctcagctatgatgacttgccatcacacttgaaacaatgctttgctttttgtgctgtatttcccaaagattatgagattggtgttgaaacattaattcagctatggatggcacatgatttcataccactgaaagaaggtgataatcttgagaaggtaggtagagaaatttttgatgagttaacttggaggtcattctttcaagatgtcaagcgaatccctcgaagagagtggtggggggagctccgtcctagaacaatatgcaagatacatgatcttatgcatgacattgccttgtctgttatgggaaaagattgtcttactatagttgataggcctaatgaaaaggagttactgtccactggtcctacacgttacttgttctcatcatatgagtatatcggaactctgttggatgattatctgaagaaacactctcccgctctccagacactgctgtatccgtatccctacaccagtgactcagcaccacacttgtcgaagtgcaattatctgcgagcactgcaactcttcagtttgagaaaacttccactctggccaaggcacttacagcacctgaggtatcttgatctctcaaataacatgttgatcgaagagcttcccaaggaaataagcatactgtataatctacagactcttaacctttgtaactgcagaaggcttgatcaacttccagaggatatgaagtatatggaaaatctccgtcacctctatacaaatggatgctcatcattgaagtgcatgcctccaggcctcgggcaactcacttctctacagactctaacatattttgtggtgagctctagtcctggttgcagtactattagagaactacaggacttgaatcttggtggtgagttagagctatctcgtctgcagtttgcaactgaagtagatgctaaagcatgcagccttggaaataaagagaaacttacacatttatctcttaaatggggtgatgacagcagtgatgaattgggccaccacaggaatgtgctcgatgctcttaaacctcatgctgtcctggagtttctaagaatacgctcctatagaggtactggcttccccgcatgggtggtaagtattaattttctgcagcatttgaccgagctccagctagatggttgtacaatgtgtgaggaatttccccaattcggtcaatttaagtcccttgaagttcttgttttgaaaaggttgaacaaacttcaaagcctatgcaatcacagttcatctgcaatatttccagcattaaaagttctcagattaaaaaaattggagatttttgagagatgggtggcaacagaaggagaagagttagcatttcctcaacttgagaatgttaaaattaaggactgcccaaagctagcaattctgcctgaagcaccaaaactcaagtttatagctctaaaagaagaaaaggcacagctatccttatcaatatttaagtccaggtatatggcttgcttgtctggggttggcctgtccgtccgtgatacagaagcagcaccaagaacagagcttgatcaggattgtgaagtatctctttcgaacctgctgttggatggttgcaactttttgttctgctcaactccattgcagccaactgttggggtctggaaatggtttggtcagcttgtgcatttggaaataaaatcttgtgatatgctcatctactggcctgaagaagagttccgttgcttggtatcattgaatagtttatccattaattcctgcagcaagctagtaggacacacccaggggaaaggatgccgtacccgtactcaagtaagggatcaactcctgccaaatcttaaaaatttaagaatacatcattgtggaagtttgacagagctttttgttctgccgccatctctcacaagtattgatatgctggattgcaatagtattgagtccatactggggcaggatgatacagagttggagagtatactacactttgatacagcatcatcatcggaacacttcaatgacctcacgtccacatgtttgctagagcagtcactttcacccagaattaatcctttgccatgtcttgattatttgcgtatagttagctgtaagaagcttcgtttcgtgccagtgcagttagatgcactccaatttttgtgtatttctgattgcaatgggctggagtcgctggattgtttgggagatctaccgtcactggaatatctataccttatgggctgcaaacatctggcatctgtaccaggaagtcttgggagttactcggcccttcagaagctccgcattgaatactgcccagctttaaatatgaagccacttcatggacatctccaacagcggcttgatagccttgaattgaaggatctatctaaggctggttcaagccatcctaatgaaggtacctttcaatttcatttaccccattttgtatctctttttccatctgtatagtttacagatgtacatattgcagcctgtagtttcaagtttatccaactccttgtattttcacatttggtatgtagtgaccgcgtacacagtttctctgatatggctattccaatatcatttatttgtataccgtaagtttgacttggattgacgtcgtcatgtgtggccgatctgtattttctatcattttggtaaaagttaatacaccatggaagtatgctctcttgtgtagtgaccgtacacagatcattcttttatgtctatcccactatcatttatttgtaaagtttgacttgctattaatgttcacagagatattctgacattgttttccatgtacagggcctaaactatgggaaccaaaatcctggaaatatatgattccttcactgcgcaagcgtgagtctgaataggcttctgacgttgcttcaggtgtgctctcaatctatacatatttactcatcatattattctccacctttttttccatctctagagctcagcttgtcattgcattgttcaattgtgcttctctagcagctacggaaattctgaacaggcaaaggtaattttacagaagtttctttggcataagtatctgagaaaaatgcacttggcacaatttaccttttcgcagtagaaaagagtcagtggatcataccttcttaattgttcgattgctcgtaatacttgggggcactctatgattgctgtgtgcttttagttttgatatagttcctgttagcatggacagactgtgtgattggttcatgaatttcagggtggttctaatgaggaaatgatgcttgcttcagaaatagtttccatttgtacctaagctgtgtagttggtaaagttgcattttggatgttctgttggtatagcttacagaagaaagacttgcgttgtgcaggtaccaggggcgcaggttactgctagtggcgtctgagatgtttcataaacgttgggtgggcaccggtcatgcaaaaaattgaaggataaaaaggttccgagaggttgtgtgatgtgctccttttaaatggcagtcgcttgcataaagagatgttgcttggttttttagtaaagcgttgtagtaagttgctctgtttcggctgagagccatcgttgttgctgtctgttacatcgaatggctggctcatgtcatgttgatgttttttttatctgaaccggacaaacctgagggtgtagtatcatgtttgtaatgactgaaattctgggctcacccgagctccttaattcgtaaacaactgcgactcattgttggattccttacttcagaaaatatttacttgctctggctcatacagctctgcatgttttgtagtggtttgtcgctgtttaggtgctgcttcagactcctggtacctttggccgctgctgctactgcatgagctttgtatggcattgttagtatagtttggtgtcattgggttttcgccccatggtgagtgtccattgcgcgcactcgcagcggtttcctggcgataagttgaacttgatctttctctttcccacctcctaaacgtctattcagacttgtgtatatttgcattacggggattacccgagttcaaaaataaatattatttactagttctgccaatgtgtttccgttacatacaaataaaagggtgcttccagctacaagtatatttttgagaagggccattgcaaaacgaaatgaagcccaaattctaccaacatgtttctgtcacatatacattaaaaaaacggtgtaaatgtcccgtcaaaaaagggtgtatgtaggaaaaggagttcgacgccgccagctccctcctaacgctcagattgtcttcgcggccgccaccgcggctgagtggctccttcaagcttgcggatccgggcggaaataggtaaagaagttgcggataaggtaattgccattgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgacccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctggcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgtttaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgatatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatgaagatcggcggcaatagcttcttagcgccatcccggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttgggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagatcc

SEQ ID NO: 160 - DNA, 7815 bp, Artificial Sequence
  transformation construct
gcgaactttactgtcaacggacacaactacgacaaacgatactacctgggtgatagtatctatcctagtggaccactattgtcaagataatacccaaccctgtcggagagaagaggaaaagatttgcccatgagcaagagagtgctaggaaggatgtcgagcgtgcctttggtgttttgcaatctcgatggggcatcgttcggtatgctgctaatatctggagcacgcagaaactgtgggaggtgatgactgcttgtgtgatcatgcataatatgatcgtagaagacgagcgaccggaacgtctgtacgatcaagggtttcagtttcagagtgagaatgttgtgcctgagcatggagtagcagcaacgtttgaacagttcatccaatttcatcaagacatgcgtgattgggaaactcacgtgcagccgcaaaatgatttggttgagtatatgtggggtcatgttggcaaccaatagatatatcttcttttattcgtttgcaaaactatgaaacatttatttttatttttatttgtatccggcttgtaaaactatactattttatttggtaaactatgttatttgacaatatgtttgaatgcaaatcaatataatattgggcggccagccagccacgccgacacgtataggtcgacgcgttgggcgcgctgccgactcaaatctaaaaaagggcggacgccgggcgggcgggcgacccaaacgaacaaaaagcgaatgaaatcgccgtccatttggatcgctccatcggagttgctctgtctggccgccaaatggggacgtgacggacaccgagtgaactcgtgcggtgtgtccgcttcacatctaaatttaggtaaaaaaatgaatccgtatggacatgttttgagaatgggtcgttacgttgcgacaatatttttatccacaacgacctaaacaaatgcgggcagatgaaatgtatggctgcgttggagatgctgttaacggagcaaagtcgttggtagtcggaccgagcaaagtaattgctgaggcaggtagtggacgagactgtagaaaggttccacgcttaatatcttgagcagtacttgtagcacatgtgtccctgcaaagctgtctccgtgctgtataccatgtgaattgcttttctcaaaagtagtggagtaccctaccgtgtttcattagtcttgccggcttcatagacaaaggattcttttttcccgtgccatcgccatctgcaagcccaaatcaacacacaccagagagagagagagagagagagagagagagagagcaacaatggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacaggaacacgggtcctcctgttccgaggcggctcatggcgtcgccaagctcatggacaagtgcaagaacttgctgccggacatcaaggcccgccgcaggatcgccaaggaggtcaaagacatcaagaaagaaattaaggatgtcagcgacagattttcaaggtaccagatcttgttctccttacagtactattagtacctaccatcagatttgtgaccgatttgttgccactcaaggtacaagattgacgactcctcctcctctatgccggcaaaagacaaggtcgaccctcgacttcgtgcagtctacaaagacgccgcagagctcgtcggaattgatggaccaaaggatgaacttgtcaagtggctgaatgagaaagaaggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcacaaatcaccaagaaagacgatgcttgctctagattagatgatatacaactcatcatcgacaagattcgagaattcctccaagacacaaggtatgtatgtgagatctgctacgaagtaacattgcttaattagctcatgcataatcggttgcctagaattttgctaatgaagattgctttgtgtgatttactttcgtcctcaacttgtatgactgcgcttaaactttcaagtcattgtttcttgcaacttatgtcgatctgttcactaattaagatatagctaaaatgtgtttgccgatttctgtcgccacacattttctaatttgattgccacaagtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacaggttgcttttggacgatccgaagatagagcagcaggatattgagatgattggattgatacccaatctgatcgatttgacactgccgcctctatacaaaacagacgacgctgggcggctcatcatcaggcgtgaaggatttcaacagttgcagaagtttgaggcttacaatactcgtatgggggttttaatgtttgaaccgggggctatgccgaggctcaaggagcttaaactccataacttcatcgaaaagcccaaatctgctgcggtcgatttcgactttggcatccaacgcctctccagccttgctcgcctcactgtcagcttatcctgcggtggctggacggtggcagaagtagaggctgcggaggatgctttcaagagcatggccgaggcgaaccccaaccgtccaatactggagatgacaagatataatacgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctagatgcctaaaccgagatgcgcctttggttatggagcccaagtcacgtactcggattggatgctgcagcaaatgatacttctgtacatgtctgcaagtatcacgaattagtggaatgactaggaataagtaagacaagtatcacgaattcagagtcggatgcaatttttttcttttcttttgggcataagtagattgtcatttgagtatttttttccattaatatttgtgtattcttagattgagactttgatatgtaacccagatttctgttgttaggaaacacataccgtgtagcttatcagaagaaaaagatctagcgtgcatctatattctatcggactatgatatttggcacatgtgtgccatataaacaaaactgtcacacctctatttccttcactctaaatagatgtatacattagtttgattctttcttctttcacgtgcatttctccttctaattagatgcatacattagaggacaaaaaagacgatgtcattctagattttctttattaaaatatttaaaatgttttgtagctcaaaccgtcggtccgatgtaaaaaccgtttttacatatacgattcgtcgcgatgagatctttg

SEQ ID NO: 161 - DNA, 7299 bp, Artificial Sequence
  transformation construct
caatttcatcaagacatgcgtgattgggaaactcacgtgcagctgcaaaataatttgattgagtatatgtgggtcatgttggcaaccaataaatgtatcttcttttattcgtttgcaaaactatgaaacatttatttttatttgtatccggtttgtaaaactatactattttattctgtaaactatgttatctgacaatatgtttgaatgcaaactaatataatattgggcggccaaccggccgcgttggcacgttgggtgcgctgccgactcaaatctaaaaaaagacggacgccgggcgggcggccgacccaaacgaacaaaaagcggacgaaatcgccgtccatttgggtcgctccatcggagttgctctgtctggccgccaaatggggacgtgacggacaccgagtgaactcgtgcggtgtgtccgcttcacatctaaatttaggtaaaaaaatgaatccgtatggacatgttttgagaatgggtcgttacgttgcgacaatatttttatccacaacgacctaaacaaatgcgggcagatgaaatgtatggctgcgttggagatgctgttaacggagcaaagtcgttggtagtcggaccgagcaaagtaattgctgaggcaggtagtggacgagactgtagaaaggttccacgcttaatatcttgagcagtacttgtagcacatgtgtccctgcaaagctgtctccgtgctgtataccatgtgaattgcttttctcaaaagtagtggagtaccctaccgtgtttcattagtcttgccggcttcatagacaaaggattcttttttcccgtgccatcgccatctgcaagcccaaatcaacacacaccagagagagagagagagagagagagagagagagagagagcaacaatggcggaagttctggtgagcgcatccacaggggcaatgggttccctcctgcggaagttgggagctatgttgacggatgaatacaagctgctcaagaacgtccgtggggacatcaagttcctcaaggacgagctggaggtcatgtgcgcgttcctcctcaagatgtcagatgtggaggagcctgacgaaccaacaaagctgcgtgtgacggcggtgcgggagatgtcctataagatagaggacaacatcgacaagttcatggtcctcgtggaacacgagtcctcctgctccgaggcggctcatggcgtcgccaagctcatggacaagtgcaagaacttgctgccggacatcaagacccgccgcaggatcgccaaggaggtcaaagacatcaagaaagaaattaaggatgtcagcgacagattttcaaggtaccagatcttgttctctttacagtactattagtacctaccatcagatttgtgaccgatttgttgccactcaaggtacaagattgacgagtcctcctcctctatgccggcaaaaggcaaggtcgaccctcgacttcgtgcagtctacaaagacgccgcagagctcgtcggaattgatggaccaaaggatgaacttgtcaagtggctgaatgagaaagagggccaatcactgaaatctgtctctattgttggatatggagggttgggcaagaccacgctcgccaaccagatccgggtcaaccttggagcgaccttcgactgcggggcttttgtctcgatttcacgcaagcctgacatgaaggcgatattaagatctatattatcgcaaatcaccaagaaagacgaggcttgctctagattagatgatatacaactcatcatcgacaagattcgagaattcctccaagacacaaggtatgtatgtgagatctactacgaagtaacattgcttaattagctcatgcataatccgttgcctagaattttgctaatgagattgctttgtgtgatttactttcgtcctcaacttgtatgactgcgcttaaactttcaagtcattgtttcttgcaacttatgtcgatctgttcactaattaagatatagctaaaatgtgtttgccaatttctgtcgccacacattttctaatttgattgccacaggtttgttaaacttgcggctatgttctgtttattaaataattgtgacatggcgtcagtcaaaacaataaagtacatgcaattccctctcttttgtacaagataaatatccgcacgcactacatgactgcaaatatatctatcttctaaggacccaaagcacttgcatgtgcagaccattgttaccggatatgcagtacattaggtttgtgattagccactttaagaacatagggtttctagaggctataaacctacggttatcagtattataatcttgaatggatatcaaacatccgttgaagaatctatgcccataacacaaaaagagaaaagggaagaattaatcatagtcagatcggaccagcctgactagcgtaacataatgacaacagtaggttgttgcgtctttcctggtttcgtagcaatttgcatgacgaattgaggcgcagagccaccactcaatatgtggtcctaccaatcatgaggaaataacttgttaccaaaatgacaaaagaaaataggtagtccccatcattgtttcaatatctatcctcttgcgaacatgctattggcagtggcaaaacattgtaccttgccactggcaacagctgcctttactcggcctgagcattcatatttttttcctcttggttgttaaatcttgctatttttcgcttgccttctatggcaatctttttttttcttatattgccaccaaattgtatctaagagcaactccaacacgccgacgcaatttttgtccatttagatcggccaagcggacggggtgtctggttttgcctttgggtggtgcgcctacgcattagtccgcgtgggcatttaaaaaacttaaaaagcttaaaataattaaatataaataaaaatgcatattaaagcccgtcaaagtccacataattaaacataatacattaatatattaataaaaaacagccgccccagcccgcagccctaggcgtcttcgtcggaggagtgggtgaggtcgaagaatgccggcagctcagcccacgggaaggcctgctggtgggcagccagcaccgcctgctccgctgtctgcggcggcggcggccctacctggcaccgcgcacgcctcctcctcgcgctcctgccgctcctcctcctcatcgcacgcccaacgaagttttggcgctcctccccctcgggttcccgctgcatgcggacctggccgtcgtaccgctcctcctccagcgtgcggtccttccacgccacgaggtaggccgcctcctcctccatcacgcacagccaaatgggcggcttgctcatccgcttgcagacgatgccctgccattggtaaacgccggtgggcgcgggtggtgctagcgctggtgcaggcggtgacgatgtggctggtggtcccggcaggtagacactatagctggcggccgatagctgcagcgtgtcatcgaggccagaccactaggagtcctcgcactaagactcctcggtgacgtgatgggccccctcctccaatgccttgaggaacgccgcctcctcctcaacctactatttgaccaccggtggcggcggtggagggcaggcttcgagctggacggcgtcgcggaggcgcacatggtgctcgatggtgaaccagacttctcagttaggggagtctggcctcgatgggtggagtcgcgacgctgctctggcgtcaggagagcacgccgggcccgaatctcgttggcgcgcgcacgctcggactgtggcaccgccggcactggaatgtggtgggggtcgaggtgccagccgtgggggaagttcacgtccggccacggcagtgagacgcggtactcccggtggtactacgcgtggtgcaccgggatgtactggtggtcccgtggcgctgccgccctcccatcccgcagcgccgacaccaatgcgaaccccttcgctgccggcctcaccggcccttgcaacgagccggcctcgtggtcgtgcttgccttgcccttacctttgccaaagaaacccatgacggctagggttttctgtcaccggcgagggagcagatgtggactagagtgggaggagaagtggatgaggcccgccccgccgcacccttgcaattaaaaagggcgtgatccggacgtttctagtcactgccatgcgggcccgaggtaggtgggcgccattgactacgtctgtggtggtagttggctggcagacacgccagcccgaggcgcacaccgagcggacgcgcaacacgtccgtctcgtgttcgtgtgaacgcaaatcaggcacaaatttgggctggaaatgcgtctacatggatgccgaacggacgtgatttgggtttgtgtccgcacgttgggccggcgtttttgtgcctttcgaccctaatggacacacacggaccaaatccgttggcgtgttagagttgcttgtacctagtactactatgtgtggagttgttatctttgagtttctcccccatctgtagctgtgtattattgtgagatgctctcaggatttcacttattttagataatgacaactttcttgatgctagacaattacatcaaggtgtattatatctaggatgcacacagatgtgagattgtttcaggattttaggttacttggtaggtgttactataaatatctaatgagctctaatgtgtatgttcatgaaactgtgttgcaggtactttatcataattgatgatatatgggagttaggaacatgggaaactttgaaatgtgcatttgtcaagaatacattgggcagcagaataattatcacaacacgtatagttgatgttgccaaatcttgttctccttctagtgaagatcttgtctatgagatgaaaccactcagtgaggctgactcgaagaaattgtttttcaagaggatatttggctgtgaagaaagctgtcctgatagcttgaaagaagctgccaatgatattttgaaaaaatgccgtggcctacctctggccatcaatgccatttctagcgtgttggtcacaacaagggaaacaaaagaagagtgggatcgggtgcgacattcaatacgctcttcaaaggtcaaaagtgatataatagagaccatgaattacatattgtctcttagttattttgatcttccccaccacctaagaagctgcttattgtacctggctctgtttcctgaagaccaattgattggaaggaagcggttagtacgcagatggatttctgaaggctttatccatggagaaagtggacaagatctcatggaattaggagaggaatattttcaccagcttgtgaacagaagtctaatacagcccggcaacatagggtatgacggcaaggcaatgtattgccgagtccatgacaccatccttgatttcctaattgacaaatcctctgaagagaacatgtgtactgtcctaaagaaacaatgcaagcctaatggcatagttcgtcggctctctctaatggggaatgaggatgaagaaatcgtggagcaattggatctgtcacacgctcggtcaatcactgcttttggggatatcaagctattgccttcgcttgggaggtcaaaatgcttgcgcgtgctagacttgcaagactgcgatcagttggaaaatcatcatatcaaggatattgaaagactctatcagctaagatacttggatatctcttctacaggaatcacggagcttcccaggcaaattggggagttgctgtatctagagacgctagttgcctatggattacgtgagcttcctgaaagcacaagtcggctacaacgactggcacgtttgtttgtttactctggttgtaagcttccaggtgggttgggaaacttgataaacttgcaagagcttgactgcgttgatgccttgcatttgaagcatgtggaagagctcggcaaactaacaaatctgagaaagctgagtattaaattggacactggtgggattgaaggcaacaaattagaagagtccaaggaaaagctggtgtcctctctctgtaaactggacgaatgcggcctcctttccctgagtattgattattatctgagagaaaaggatggagaagagccgttcctccctgctttgggttgtatccaggaggtttttgtatatggacaagatatcagccggattagcagatggctcgcgtcacttcccaacctacacgggttgcttttggacaatccgaagatagagcagcaggatattgagatgattggattgatacccaatctgatcgatttgacactgtatttacgcataacagacgacgctgggcggctcatcatcaagcgtgaaggatttcaacagttgcagaggtttgagctttcccgtattcgtatgggggatttaatgtttgaaccgggggctatgccgaggctcaaggagcttatactctaccacttcatcgaaaagcccaaatctggtgcggtcgatttcgactttggcatccaacacctctccagccttgctcgcctcactgtcggcttattatgcgttggctcgacggcggcggaagtagaggctgcggaggatgctttcaagagcatggccgaggcgaaccccaaccgtccaatactggagatgacaagactttatccgcagcatatgttacaagacgagcaaataggtatgacaggctcaggtactattaactagtttgtacttttgtcttggtgagcagtagatcaaaagatgtgcatatgcttcaatcttttttccggtaatctatttcagctacaacgccggccgtcaagtcctagatgcctaaaccgagatgcgcctttggttatggagcccaagtcacgtactctgattggatgctgcagcaaatgaagctacacatttctattcgggctacctctttttttttgaaactctattcgggctacctctttgtctcaaagctggtgtactcttgtgatttgtgttgcgcaactgatacttctgtgtatgtctgcaagtatcacgaattagtgggaatgactaggaataagtaagacaagtatcacgaattcagagtcacatgcaatttttttcttttcttttgggcataagtagattgccatttgagtattttttccattaatatttgcgtattcttagattgggacttagatatgtaacccagatttctgttgttaggaaacacataccgtgtagcttatcaaaagaaaaagatctttagagaaaataacatcattagattgttcaacttggatgaaaaatgtgaaaatggccaaaccataattaaataacatc

SEQ ID NO: 162 - DNA, 6481 bp, Artificial Sequence
  transformation construct
agtactgtaataattgattccgtcgcgcctctgcgtccaccgcccaacagcccaaatcgccgccgcctcgctcttccctactccggccaccgccgccgccgacggccacgctccgctgtttccccccaccccacccctccagcaccatgcctctgttcctcgttgccacatcggtaacctgccccacaggcggccccaccgtgctgctgtggggtggccgtcgatgtcgccggcagggtcctcccgcgtgcttctccaagcgacctctgccagctcctcccttgtctcgcgtcgcctgccatgcgtggctcggacccaaaatcttttcgcccgttcgcggagccgggtagggaggggggcggagatgctctgaacttgaagccgagatatttggagtgcagcagatggactcatttttctaagagcgcacatgctatatatcagcggtaaatttcctcatacattgttgctaacggagcaagatttgtagccaaacgaagatttgttttcctggtaacgaaggattctgtattgtttcacctacccataacaaaaagataacgcatttctgtatggcagggctgcgtggtggtcgttgaagtcgccggccccgctgtcccatttttttccacacgccatcgtccacttgctctgaatctgcctaactccagaccatttcttccacacgttgctcttatccttttgcgcgtgcttccgcgcggtctcatcctgttgacctgctaaatctgcacaactacatgccatttctcttctgcatagatctcacgctctcatccaggtttcctggatctgcacagctgcaggccatttctcttctgcatagcgcttgtagtgtttccctgtgtttgcagtgtgagagctaaaatggcggagtttgtagtcaggccactggtatccacgttgatgaacacggcatccagctacctgctggaccagtacaaggtgatggatggcatgaaggagcagcgcgagaccctcaagcgccagctgccagccatcttggacatcatccaagatgcggagaagaaaggagcttccctacctggagtgcgcgcttggctcgaagcactcaagaaggtggcctatgaggcgaacgatgtctttgatgagttcaagtacgaggccctccggcgtgacgccaagaagaagggacactacaagaagcttggctttgacatcgtaagcctcttccctgctcacaaccccattgtatttcgttacaggatgggcaagaagttgtgcaggattgtgcgcaaaattgagggccttgtcagagagatgaatgacttcggattcaaccaaactcagcaagcaccaccatccaagcagtggcgcaacacagattccataataattgactctgagaaggatattgtcagcaggtccagaaacgaagagaagaagaagatcgttgatatattgattgatcaagctggcgatagggacctcatcgtccttcccattgttggaatgggcgggctgggcaagaccacctttgctcagcttgtctacaatgaccctataatcaaggagcatttcaagctccagaggtggtgttgtgtgtcagatgattttgatgttgtgaagattgcaaacaacatctgtgagaccaatgagatccatcgtgaaaaggcattgcagaaccttcagaaagaagtaagtgggaagagatacctcattgtgttggatgatgtatggaatgaagatgctgataagtgggaaaaactgaaaacctgcctgaagcacggtgggaaggggagtgcaatattgacgaccactcgcaatgtgcaagtagcacgaattatgaagatgtgtattgctgatagccataatctcagaaatctagataaagtatttctgaaggaaatatttgagaatagagcattctgtttgcaaaagccaaaggctgctgagctaagcgatgtggttgataagattatggacagatgtggaggctctcctttagctgccaaagcctttgggtctatgttgagtaacaagactagcatgaaagaatggacagacatactagccagaagcaacacttgcaatgagggcacaaaaacttttcttgtactcaagctcagctatgatgacttgccatcacacttgaaacaatgctttgctttttgtgctgtatttcccaaagattatgagattggtgttgaaacattaattcagctatggatggcacatgatttcataccactgaaagaaggtgataatcttgagaaggtaggtagagaaatttttgatgagttaacttggaggtcattctttcaagatgtcaagcgaatccctcgaagagagtggtggggggagctccgtcctagaacaatatgcaagatacatgatcttatgcatgacattgccttgtctgttatgggaaaagattgtcttactatagttgataggcctaatgaaaaggagttactgtccactggtcctacacgttacttgttctcatcatatgagtatatcggaactctgttggatgattatctgaagaaacactctcccgctctccagacactgctgtatccgtatccctacaccagtgactcagcaccacacttgtcgaagtgcaattatctgcgagcactgcaactcttcagtttgagaaaacttccactctggccaaggcacttacagcacctgaggtatcttgatctctcaaataacatgttgatcgaagagcttcccaaggaaataagcatactgtataatctacagactcttaacctttgtaactgcagaaggcttgatcaacttccagaggatatgaagtatatggaaaatctccgtcacctctatacaaatggatgctcatcattgaagtgcatgcctccaggcctcgggcaactcacttctctacagactctaacatattttgtggtgagctctagtcctggttgcagtactattagagaactacaggacttgaatcttggtggtgagttagagctatctcgtcttcagtttgcaactgaagtagatgctaaagcatgcagccttggaaataaagagaaacttacacatttatctcttaaatggggtgatgacagcagtgatgaattgggccaccacaggaatgtgctcgatgctcttaaacctcatgctgtcctggagtttctaagaatacgctcctatagaggtactggcttccccgcatgggtggtaagtattaattttctgcagcatttgaccgagctccagctagatggttgtacaatgtgtgaggaatttccccaattcggtcaatttaagtcccttgaagttcttgttttgaaaaggttgaacaaacttcaaagcctatgcaatcacagttcatctgcaatatttccagcattaaaagttctcagattaaaaaaattggagatttttgagagatgggtggcaacagaaggagaagagttagcatttcctcaacttgagaatgttaaaattaaggactgcccaaagctagcaattctgcctgaagcaccaaaactcaagtttatagctctaaaagaagaaaaggcacagctatccttatcaatatttaagtccaggtatatggcttgcttgtctggggttggcctgtccgtccgtgatacagaagcagcaccaagaacagagcttgatcaggattgtgaagtatctctttcgaacctgctgttggatggttgcaactttttgttctgctcaactccattgcagccaactgttggggtctggaaatggtttggtcagcttgtgcatttggaaataaaatcttgtgatatgctcatctactggcctgaagaagagttccgttgcttggtatcattgaatagtttatccattaattcctgcagcaagctagtaggacacacccaggggaaaggatgccgtacccgtactcaagtaagggatcaactcctgccaaatcttaaaaatttaagaatacatcattgtggaagtttgacagagctttttgttctgccgccatctctcacaagtattgatatgctggattgcaatagtattgagtccatactggggcaggatgatacagagttggagagtatactacactttgatacagcatcatcatcggaacacttcaatgacctcacgtccacatgtttgctagagcagtcactttcacccagaattaatcctttgccatgtcttgattatttgcgtatagttagctgtaagaagcttcgtttcgtgccagtgcagttagatgcactccaatttttgtgtatttctgattgcaatgggctggagtcgctggattgtttgggagacctaccgtcactggaatatctataccttatgggctgcaaacatctggcatctgtaccaggaagtcttgggagttactcggcccttcagaagctccgcattgaatactgcccagctttaaatatgaagccacttcatggacatctccaacagcggcttgatagccttgaattgaaggatctatctaaggctggttcaagccatcctaatgaaggtacctttcaatttcatttaccccattttgtatctctttttccatctgtatagtttacagatgtacatattgcagcctgtagtttcaagtttatccaactccttgtattttcacatttggtatgtagtgaccgcgtacacagtttctctgatatggctattccaatatcatttatttgtataccgtaagtttgacttggattgacgtcgtcatgtgtggccgatctgtattttctatcattttggtaaaagttaatacaccatggaagtatgctctcttgtgtagtgaccgtacacagatcattcttttatgtctatcccactatcatttatttgtaaagtttgacttgctattaatgttcacagagatattctgacattgttttccatgtacagggcctaaactatgggaaccaaaatcctggaaatatatgattccttcactgcgcaagcgtgagtctgaatagagatacaactaccatgtatgtttctggtttttttttcttgcaactttgattctaaaagtttgtaggctaaaagatcggttttggtatgttcaccattcttgacctgaatgtgtttaatttccttgcagggtcgctcgtgtgcgcatacaagtgatgaacacaattggtaactgccctcttcaagggagtcaagttcttttatttgcctgctccgtgagctctgatgaaaataaggcgctcgaaggcctgaagcatgggggaaaatgaacttcaacttgcagaactggagagagaaggtcgtgctgaatcgtgtttactttgtgcagaacaaacaagcatgtccttgggcaaatcgtgcggactataagtgcacttgcagtcgtgtgctggcgatcgagccttttgttttccatgtgtacttacagttcaccgtagtaatacggtgtgctatttcacatcttttacataatctttagagcagagcacgatcctggttaattcagacagctgattagcagacatctggttagttcagagttagagattgtgtgcgtgtgtttatggctgcttcagagagctgattgtgtgcgtgtttttgtgcgtgcacgacgtgctagtatctgcttgccaattcgccatgtacacaaaagtctgcaaccaaacttggaagatctcaaattaccagtgcctttcaggatgaacatacagtacatgatttcagaagagtagagtgcaggtgccagcttccaccattttgttctgccgcaaaccagagctgatcgcagcaaagaaattatatagacagccatggtagtatagtaagctcactctagttcttcagttccagcaggcacacatgtcctctcaacagaacagaacagaagggaacagccccacaccgcaggctgttgtcaccgactcaccgtgcacaaacctgcttccgtccattttacgacggtccgtcgcttgccatctctagcttcccttttttttgatagaaagaccgtaatggaaccccctacagtataattggtgcaacaaatccaaattgcaagtaccataccttgaatctgggtgggtgggaaggcatcaacccctccccatcactaggctatgccttagtctgccatctctagcttccctaccgaccagggaatcacggctcgtgctaccccttttagcaccccgacgaggagtagcttctgcacggattatagtggggaagaaaatgtatgactaggatacaggaattccagagaagccaaattcaggaaacaaccaatccctttattttacaaagccgcccataaacctttttttaataaaacatggtagtacggggattttattttaataaacaaccaatccccttcttttacctggtattatgattttatccattccccaataaccaacataatttcttctaccaaaaaaacaacccttggtgatgaatttattcagcataatgagaagaacatgtataactgcaatgcagcaggaatttc

SEQ ID NO: 163 - DNA, 12150 bp, Artificial Sequence
  Vector
gtcgacgatcgtcaacgttcacttctaaagaaatagcgccactcagcttcctcagcggctttatccagcgatttcctattatgtcggcatagttctcaagatcgacagcctgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattccaatccccaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagtataagagctctatttttacaacaattaccaacaacaacaaacaacaaacaacattacaattactatttacaattaccatgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcaaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatttgatgacccgggggatcctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggacctgcaggcatgcaagctctagagcggccgccaccgcggctgagtggctccttcaagcttgcggatccgggcggaaataggtaaagaagttgcggataaggtaattgccattgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgacccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctggcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgtttaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgatatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatgaagatcggcggcaatagcttcttagcgccatcccggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttgggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagatcc

That which is claimed:

1. A transgenic plant or seed comprising stably incorporated in its genome a heterologous polynucleotide comprising a nucleotide sequence selected from the group consisting of:
   (a) the nucleotide sequence set forth in SEQ ID NO: 1, 4, 7, 19, 22, or 25;
   (b) a nucleotide sequence encoding the amino acid sequence set forth in SEQ ID NO: 2, 5, 8, 20, 23, or 26;
   (c) the nucleotide sequence set forth in SEQ ID NO: 3, 6, 9, 21, 24, or 27; and
   (d) a nucleotide sequence encoding an amino acid sequence having at least 96% sequence identity to the amino acid sequence set forth in SEQ ID NO: 2, wherein the nucleic acid molecule is capable of conferring resistance to stem rust to a wheat plant comprising the nucleic acid molecule.

2. The transgenic plant or seed of claim 1, wherein the heterologous polynucleotide comprises the nucleotide sequence of any one of (b)-(d) and further comprises a promoter operably linked for the expression of the nucleotide sequence in a plant.

3. The transgenic plant or seed of claim 1, wherein the transgenic plant is a wheat plant and the transgenic seed is wheat seed.

4. The transgenic plant or seed of claim 3, wherein the plant or seed further comprises at least one additional wheat stem rust resistance gene.

5. The transgenic plant or seed of claim 4, wherein the additional wheat stem rust resistance gene is selected from the group consisting of Sr26, Sr32, Sr33, Sr39, Sr40, Sr45, Sr47, and Sr50.

6. A method of limiting wheat stem rust in agricultural crop production, the method comprising planting a wheat seed and growing a wheat plant under conditions favorable to the growth and development of the wheat plant, wherein the wheat seed comprises stably incorporated in its genome a heterologous polynucleotide comprising a nucleotide sequence selected from the group consisting of:
   (a) the nucleotide sequence set forth in SEQ ID NO: 1, 4, 7, 19, 22, or 25;
   (b) a nucleotide sequence encoding the amino acid sequence set forth in SEQ ID NO: 2, 5, 8, 20, 23, or 26;
   (c) the nucleotide sequence set forth in SEQ ID NO: 3, 6, 9, 21, 24, or 27; and
   (d) a nucleotide sequence encoding an amino acid sequence having at least 96% sequence identity to the amino acid sequence set forth in SEQ ID NO: 2, wherein the nucleic acid molecule is capable of conferring resistance to stem rust to a wheat plant comprising the nucleic acid molecule.

7. The transgenic plant or seed of claim 1, wherein the transgenic plant is a wheat or barley plant and the transgenic seed is wheat or barley seed.

8. The transgenic plant or seed of claim 1, wherein the heterologous polynucleotide comprises a nucleotide sequence selected from the group consisting of:
   (i) the nucleotide sequence set forth in SEQ ID NOS: 1, 3, 4, or 6; and
   (ii) a nucleotide sequence encoding the amino acid sequence set forth in SEQ ID NO: 2 or 5.

9. The transgenic plant or seed of claim 8, wherein the transgenic plant is a wheat or barley plant and the transgenic seed is a wheat or barley seed.

\* \* \* \* \*